United States Patent 8,709,766 (USE OF ENDOGENOUS PROMOTERS IN GENETIC ENGINEERING OF NANNOCHLOROPSIS GADITANA) - sequence listing, part 3

SEQ ID NO: 6851 - DNA, 700 bp, Nannochloropsis_gaditana
cccgtcatctgcttcccttagggcgatagagcccgcccgtttaggaagcgagaaagaggctgagcgctcgtcggcgggcgagtatgtgtggagtgtcttcccttcgatgtcaatccagagcaatacctgtgcctgcatatcccataccgggctttcgccaagtatgtttttcaaatcctacaaatggagggagaaattaaaaaaaacgaatcttagagctagagggtattgtgaggagaaaggaaaagatgcattcgccggaaacgagcgcaatgggcatagattcatgtcagcaaacaaatctcgcttatatcatgttctttacacggtgtcgagttggtgtatgcctctcgcataaactgcatgtgtgtgatttcagagacctaccaggacgagccgaggtgaagcgctgggatggttcgccatggggttgaccagcgaagcgacaacgggctatggcttgattgaagaaaagtgaaatcaatcgtgacgtctatcttgcatgcttcataccgcgtgcccacgccacccttgttgaaaaggcacacaagccgtgggggaatggtgccctgggtcgcaggttgtagttggcgatgagcttgcgtcttgttttagctgacactgaacccacggcaacattgtttttccgtgctgccacctgcgtttcacaatgtattataacggtgttggtacaggaatg

SEQ ID NO: 6852 - DNA, 700 bp, Nannochloropsis_gaditana
ctacatttcttccgcaatagtccatgcacagcaaacccactacatgcaaacgtacggtactgcccgatattccattcccgttcctgggagacgctttgggtgttgtgtgtgttgccgccgatgacatgataaagcgctttcgcaagccaaacgacagcaaacagaagatttcccccctatggaagcgttcctgtctgtgtacgagcatagggtgaaggattaatgattgctcggacatctccttgggaggtgaagtctcggcaatcacgccactcgttgattcttcaccattcggcagaggcaatgatttggtccattgatgcgattcatacatggaccagtgagttatacgtaggagtgggaccgcatatgtacatgctagcggtgggttgaagccagacatcatgcaataagaacagaaggcatccgatcgaggacgaaggcgccgccggacacgaacgactgtcttgggttgttttaccaaaaaagataagcactttctttgcccatcgcattcgtctcaatacgagcttatgcgcaccgatatcctccgacaacttatgattgtcgtcgtgtcaaattaccggaatagaatgcttttttattgcaatgtttcctttgcccatgacctccccacccacagcattggtcgtgtctacttatttcgcacgtcgacaggctttttcgacgtacagcgatg

SEQ ID NO: 6853 - DNA, 700 bp, Nannochloropsis_gaditana
ttggcagggtccgacccgttgccgcagggagcgggagggagggaaggagggcccagaggagaggagggaggcgcgtcgtcccacctcccaccgtcgcacccttccctgctactctcacatccggatcccctcccttcctcccaccccgacctcctcctgcccggcggctcccagcctccccttcctcccgccttcccctcctttaacggtgctcccccgcctccttttcctccccctccgccccacctcctgggcctccctccccccctccctcctccccctgtcaatgcggccgggaagagtcggcggaggagcaacagcaacgggggaagccaccagctgtctccctacgtccccgacttttccccgcatccgccccaaccgcagccctcgcagctaccttccctcccttcgcatccccccacctcggaaccccagaccggcagcagcagtcatgggagcaagcgaggggtgcccacgctcggacaaatggcggcccaagtccaacacattgcgcgaaagaaagcccggcagttgggatacccggatgaggacggtcctgccctggttcaggcctgggagggccattcccctccctccctcggtccttcccccccgccctccctcgggtcctccctcgcccctgtctgtgccccgggcgccgagcacaccggacgttggtcccggctggagcacgatc

SEQ ID NO: 6854 - DNA, 700 bp, Nannochloropsis_gaditana
  misc_feature (435)..(444): n is a, c, g, or t
ctaatgcacctacagatggaagcactccgattccctagccctcgctctccttttcacttttcccccctatatctgtctatgccttgtccacctgcacgacgtctcattttctgcgtggtcctgtgggcgggttagtccctttttttcatttgagccatcaatttgtgtgagttttggccctttggactcgaattgatctccttgtaagaagtaatgagattcgggaaagactttgcacggctttaaagtagaagcaagtgttgagttacgagaatgtagcataccatggaaatttaaagaagaccacaaactagaagaaatatgattcggaaagacgcatgtttgggtgaagagatcaccgcgatgacatccaagcgtacattacttattacatattacatattacatattacttattgcattcattgccttggnnnnnnnnnnggccgccgccacctaccactccctcctccggtcgtcctcctccccccggcgggcagcttcccacatgtgtttcgcctactggcccgggacatctccctccccttccccccttcctttcctccttcggtaccaccagaccgggagccggagcttgctagacatcgtcatggagacggggatctttgcctccaccgccttcaccttgtcacggctgttgaagaaaagttattttttcatcgacgtggagaaatacatg

SEQ ID NO: 6855 - DNA, 700 bp, Nannochloropsis_gaditana
tctgcccaggtctgggtaatcgtccccattttgcgtgggaagcagactctcacgtaacgcctctttgtccttgacggagagcgagcgacctccccccccccctctttgcgaaatgcacaatgaagtcttttttgaaaagcctgtaagttgtagtgccgacacacacgcacactgtgtgcaggcagacaacgcttggatatcgtttccatccaaataatgtgaaagttgaaaaagcgtgcgtggaccacctccttcaagcaggtgcaagcccattcctgtagtaaagtgacaggaccagttcgcggagcatatgtctgacgtgcgccattacagctttagcgtgaccgaacctcatattaaacaaacttttccgtgtactggcaggaaatagaagaggcattccccttgactcctgagccgggcagcgggtctcgcctctctctcatcaaactcaagtgtgattagtccttggcaccgtcacctctaaaggcagacgccgcaggacgcagcacagagtaggaatttgcgaaactattgccattcaaatacccgctggcgggagacattgcatgaagatgggcgagagtaacaggagcataaagaggcatagcgtacggatgaggagtatgcgatcagctgggacagccgacgtcacgcacgagggaggccaggacccattcgaatcaacattaagcccatg

SEQ ID NO: 6856 - DNA, 700 bp, Nannochloropsis_gaditana
cctacgacgcccgccaaatcggattcgaaattgcgcgaaattacgtccgcctgtacacgcaggcggaacgcgacgtcttgaacgagcagtacgaaggactcttgaaatgccacgggcgggacccagtcgtggcttggctgcacaaggaggtaatgtggccgatgcgtcctccctcgtctttccctgctgagtcctccctattgcttgccagccccccctctccccccttcccggccctcaccctgctttcttcacgtttcccttcctcctttctcaggtcgtcctcgacgtgcttgagtcctccaacacaccctacctgaccatcctcctcaacggcatctgcccccccttcctacgcccggttcttctggcttttttctcctgcttggcttgctgctgctgtcgctgcctccctcgttccctccgcccggccctcccccgtgacctcaccccgtcctattggcaagccaacctggacgatgaaatcaccttctacacttttcaattcgtcgcgctctccgtccttcccctcttcccttccctcctccaggccacgctgggcatcatggcctcccagcattgggcccttgatgctcagtcttgcaccaccctccttccccctacctatgaaaccaccagccgcacctgtcctttcgacctcacggcccggcagggcgcgggggagggtggggactacatg

SEQ ID NO: 6857 - DNA, 700 bp, Nannochloropsis_gaditana
agcacaggaagggtcttgacccagggccccctcggattcctcgattcacaatagcaaatcgctccctagaacgtaccgcgacacaataggctcatcaagagccccagatggcgcaactccttcaactgcagtggaagacatggcccgcttattcacggcaacacacggcgcggatgacagcgagactcgcgactcgcattcgaggggccgctgcagcatactcggtggactgcgagcaagtggtggagaggaataccggctaaaaaggcgtcgcagcatcgtcgatgccattgatgacctgtgagagttgatgtataagattgtcctatccagtcgtttttggccgtttgaggtgtcaaatcgaaccgggaaattcccctgaaagccggggcggcggtgaggggtggttgggcctccctgtccccctctccccttcctggacgttgccttcgtccttcgtccttcatgtgaacgaatcgataggttctgtaaccacaaaaatccttaaaatgagaattaacttgcctctctcatgcgttcacgtgtgctctcgctcagtggcgcgcatgaatgtagggagacgcaggccgtcaaatgcagtgtccgccctcacctccccctccttctgcttcagctcgagcgctttacagggtcagcttggcggcatctgcccaagctgggtagggtgcggcccgtgatg

SEQ ID NO: 6858 - DNA, 700 bp, Nannochloropsis_gaditana; identical to SEQ ID NO: 4549

SEQ ID NO: 6859 - DNA, 700 bp, Nannochloropsis_gaditana; identical to SEQ ID NO: 4550

SEQ ID NO: 6860 - DNA, 700 bp, Nannochloropsis_gaditana; identical to SEQ ID NO: 4545

SEQ ID NO: 6861 - DNA, 700 bp, Nannochloropsis_gaditana
ggcaggtcatccccgcctgcagcacgatgaacagacacgcaccacatggaatttacaggattcaagagaagcgcctccagggcctggacaacggtgagtaaggacaaatagcaccacagagcccaccttctgcagaaagaagttcgcgcgttacgttgctgcgcgggcgcggggcctgctcgacagtagttgtagttagctctgcgatggcgtcatttcggccttgggcagcgtcgatgttcttcaagccgccatcctttttttcagcctggccgaactcaacgccacacgcctcttttggagcctgtcctcttgacaaaaacatcaagaatttgaatgctatgcttgtgaatgaagagttgcgattgaaaatttttcaagtaaatcactaagttagcttttcgactgcgttcctcattccctccctctccaagaagaggggcgtcaaaagagggaggcgagatccctggctttcaatcccgttctcatacattcacgcacaaactgatccagaatttggcacattcgcgctggattcggaggcttgtgggaaaagcggcacgctaccaccggcacaaggttcctcgtctcgcagcaagtgcatattagcaagcaactcgtcgcatagctggggtaactacggcggcggaaagagcgcaaaagtgagggtcggctttcaaatctcataagagaaatcatg

SEQ ID NO: 6862 - DNA, 700 bp, Nannochloropsis_gaditana
gacccgccttcttctcccttcatgaaagttccaccaacaggatggcgcggcggcgagaggagaaggaactgaaggatagcatggaggcagagatgcaggcagcgttgaagcgggaagaagaggaaaaagcagcacgaaaagctgctcaagttaaagagacgcccaaacatgtagggagccggatgcagacgccgggtcggtggaccccccgccgcgtgggtttgtagtgcccgaggtgaggatactaccgcttctcgcatgtgcattgcatgggagcacacttaattttgaaagcatttattgaatttgctcgcgtgcatgtacattagcaaaagaattcagacataaattcataaatttgacaagtaatcgaaagggagggggggaggttggatccgagtcaacgcccttcgttgtaccttctccttttttcttcagtttcgattaccagcgattctgccactcacctctgactgccctgtgtgagcaatttcgcctacctaacctgccgaacgggaacacaacgtggtatagataagcacctttaaaagctgcgtgtacggggatggagagcgacctgtgtgcctcttcttcttcgcgatcgccttggtcgaaaacctcgccagaatcgtcctgactcgttccggctggcgtgatgcacaacaaacccgagaatgccagtcgcctaggcgtagcaatg

SEQ ID NO: 6863 - DNA, 700 bp, Nannochloropsis_gaditana
ggaggccgcgtgggaggtggaggagcgccgcgaagggcgcaggggggatcgcgggaccgggagcgagagcataaggcccgcagtgcccgagacccccttcgactggcgggcggcgatgcgggaggacgggcgggaggcggcctacgtggccgacgggcggaagccggggggccccgatgccaggcctgggagctcgctgcgacagaggcaaagggggcggaaggaggaggatgaggaggatgaggagtactacgaggccttctatttggcggaggagggcgtctctcggggggaggacctcttcgggggcgacccggccacgctccgagagaaggaggaggccatgcgcaagctgcaggagcgtaacgaggccaacaagcgacggcagcagcagaacacacgcaagaaccagctagccgcggaccagaacgcctgggaggagaaccggctcctgacctcgggcgtggcggtcaggaacgaggtggacacggacctggcggacgaggaggagacgcgcgtgcgcctgaacgtgcaccataccaagccgcccttcatcgacggccgggtcaccttctcgaggcagctgaccaccgtctcggtggtgaaggaacccacctccgacatggccatcctgtccaagaagggttctgctttggtccgagagcgccgagaacgccgggagcggggcaagatgcggcag

SEQ ID NO: 6864 - DNA, 700 bp, Nannochloropsis_gaditana
ggtggggcgcggggaggttgagggaaagtgtccggcaaaatcacttacaaaagccagtattaagcatgaacagttccatgcttgcccctacgaccatgcatgcggggacgaggcgtaccactatttcgagaaaagggcgcataaccgcaaagctgggtggagggtacgcagggcgcgtgagaactgccgagcgccttatattgaagataacagcgccaacacgagcgcagtgattgattgctcctgtccgggtggttaaattgtacgtgatataatcgattatataaaagaaggagtggtttgtttggctttgttttgcgtcgtcttttttacgacgcgggaggtacctaaaccatcacagccccatcgtcatcgtcagcaccgacgaagtacagccgaaggcagaagagggctgtcattcagagaacttgacaagcggagagggaaggaagtgctcaatcatttctagatctcccacgagtgtgtcctcgtgtcgcaagctgacgtgtcctcttttcgtactaaaacttttcttgccaacctcttcttcacacctgtcaaatttatcgcctggtctactgtatggatacctcagccgttgtcttcccggagccctcacacgcgcgcgtctcacgcaaattttacctgtgattatcgggcataccatatccacaaaggtcactcacaagctaaaagcatg

SEQ ID NO: 6865 - DNA, 700 bp, Nannochloropsis_gaditana
acaaaaaaatagtgtgaacacaacacagtgtggatgcgtcgaaacatcccaggagtgtattcatagaaaagctcaagatcttcccccctccaactagcaactagcctctcacctgagacgtaatgtctccctgcaattgacgcacacctgggatcggcgccatttcttgcagatccacagcaatcactcgctctctttcacctcctttgtcatcagtgaaggcaccgtcaggatataaacgcgtggctaaaacttgactccaactcccgggtgcggcacacagatcgacggccttctgtacattcctgaaaagaccgaactcctcatccagctgcaggagtttgaacgcgctgcgggcccgaaagccgacctccttcgccttccgatagtaaaggtcccttacaaccttacccatggcctgcgtgccctgttctacgtacgtgatgggtgattatgtcagcattccgacctcctctggggtgctgcttctccggctaccggctgaaaagcgtccgacgactcggagttgaagcaagcaaggacgtgcgttatttactactaaaactgtgggctgcgtcctttctcgccccgtgcatgacgtccatttgatagtgcacaacgttcattttataaatgatgacattgctgcagcctcttattaatctttccatcttgtacgcatagcagtgccattacgatg

SEQ ID NO: 6866 - DNA, 700 bp, Nannochloropsis_gaditana
gttgggaaaccacctggagctcccgacggtcttcgcggtgatgacgctgctgcagacgttgagggagtgcgcacgctgggtacctcggagcatcgagcaggtttcagaggccctggtggccagtcggcgtattctacccttgcttttgatggctgaagcggggtcgagcacacagaattgcacggaggcaggcagtagcgggggcaaaaaggaaggtggcggcgccaagggaaggaaggctcagtggggccggagaccatccgcgacaagagcttttgccgaagtttcaagcaacaagtcgtccttgttactgggcagccgcgaccctcacggcaaagagctgggcgcacgcctcctccctccccctcctgcgttgcctccctcgatccccccgcttccgactcttacggcgcccccgacgcagccatcggtcggaaatagaggagatatactcgtcgagatcgaagacagtggcttcagttgggcgacaggaaatgtcaaggggcaggggatcgactggcaggcccgtgccgagttccagctcagtctgaaacatctcagcatgcatgtgagacgtggagaattgctgatcgtcacaggtccagtcagaagcgggaaatccaccctcctggatgccatattgggggaggtaacttgcgtgtacgggagcggagtgcgtttgcgatcggacctccggatg

SEQ ID NO: 6867 - DNA, 700 bp, Nannochloropsis_gaditana
acggattcccctcatattgctcgtattttatcgagacgcagtttctgccattaaccgaagaagatggcatagtttctgacaacgaggcctcttggactccgcaatcgtcaattagttggcagattttgttgctaggtttaacctccccacaccctcaacgcccccgcttcctgagaccttgctagcagtcgatgatctgcaacccggacatgccgtctgcctttttttcccacccgggtgtattctgagtggtcttttaaacaataataatgtatggcgaatgctactcaggatgggtagtgaccgctttaatcacaagttgtacttacattccttgtgtcatcccacagctatgccgcaagcagaggctgatgctgctctgacccctcctccagcgccgccgccgccgccatcaccacctgtggacctttacgagcgtttgactccatggcagctgttgactttcacgtttgtatttcccatagtacgatgcgggacttacaagcctttgcaacaagtagacctcctccccgttgccaaacgagaccgggccgcccgccttttgacgtgtctggagggggaatgggatatggaaatgcgtgcctacaaatatccaagtctcaatagagcattatatcgcactcatcgtagggttttctacctctgcggtgcgctacttttcacagaatacgctatcatg

SEQ ID NO: 6868 - DNA, 700 bp, Nannochloropsis_gaditana
gatgagtgaagaggtggtgtgatcatgagctcttatcccgccctttgcttctgttcccgggactacgcccgggcgaggcaatgacatggccgtcacatgcgatctccctccgcgatatcaccacagacacaacgaactcagccgcacgccctgctttccccgtgatgtacacgcatgaggcgcttgtggaaagcctacgtttttcaaatgtgccacacgtgcttggactgtcttttgggctgtcctgtgtgcttgggggcacggattttgggacgaaagtggcgcctataattgcccccagggtttcggccttgctgacctcatgatcgctcatccacgcctcatgcatgcacgcattatttgatccgacagtgcatccacaggggatacgagcaggtgattcgcgacacgtgactactgagtttgctaccgtggctgtgaaaggatgtcttggcatgctctggggcgcaacaaccgaggcagacaagatttagggcggggcctgggcatacgtgtgggtgtcctcgtcctcgccatgacgatgccgcacagaatagggggattcgtgctaccgaagcccggagtcacgctagcgcctcgaatccctcaattactagtcccctcttgtacgcctagcttctctgccccccttgtcgcagcccctcggaacgcggcgagaagaagaagagcctcttcgatg

SEQ ID NO: 6869 - DNA, 700 bp, Nannochloropsis_gaditana
ggctatgccctgatggtcgtaaaatagaggtttttggtcgcaaacataatatacgtgaaggctggattacggtgggaaaccagttgcctcccactcatctggtcggcgacaccctcgttcgatatcgtgaatgggaagcaaccgagcgataatgtgtcactcaatagattcaaatttataatcgggattcaatgtgatttgaaagggaaacaaaagaaagaccagaggaacattttggaagatgcaccgtcatgatacttcttttgatgcgtcctcagcgcgcttgatccttcggcatgcgtccctccgtacgtcaacccttcgacacttgaatctctgatgatggatatcaactgccaaaacattactgtgcatggtttactcgttgaaacccgacaacttgtacagggagcaggtcttggcccgacgggcccttgaagaatacatgggccggcgaagactcgctgggtcggcgggagcggagaagacgtcgaagtcgaacgatagggcccctaccccgactctctcacggcgtaacatgtcatttgatcctgacacatgactttttaacaaccttaggtcatctgacgtggacggtcaaggcgagtttttggccaactgcttctcgtaacctgctcgcgctcgtcacccatttaaaactccacaaagattagtaagccgactattacgattcatcatg

SEQ ID NO: 6870 - DNA, 700 bp, Nannochloropsis_gaditana
aacaactcaaagcatgtgccaagtccccatacttaaaacttgcccgactcgcttgataatgctgtgctggtctctgtggatagtaacccctatcctttcatgaagacatggatctcgagttgcgcccaacccgtgggtgaaatacaagacgtactctgcaagcgaagcttgaggactatagatttgctgttcatctggggaggggcgacgagtgcacgcagaaagtgccagcgcccatcagagaactcccaaaatccgtgcatggcaaagtccgtcctagtgcttttataaacatcgtctctatttaatattcatcgcattccccaggacgacgagagcaggcatggcagtgagcgcgaggttccgatcgcggtgcgggctggccgtggcgttgttgacgtgcggatctttcttgacgtcagccttcccgggcagccaacctcccaccctgcccgcccgccctcttgctggcagacggccaacgtttctgtcaccccgacgctcgtatcgtcctcaatatacaagaaccactttttcaagtgccttcgctgcagctgataatgcagctcttcgaaacataccaccatcctcgcatggctacaaacctaaggtctgggcgtattatcggtccagatcgaaaattatagagtggtattgtcaagaacttggcgttgattacgaagccgtacaagtagatatg

SEQ ID NO: 6871 - DNA, 700 bp, Nannochloropsis_gaditana
cccgcccccgcgactttcttccatatcgtcacctgcttatccccaggatggacccacatgcaacatatatcccttttgtccacccattttcgtctcaactacgtaggtcgtgttagcgcgctttccccttatcactacgtgtggaagaaacgcggcttgctcggcgcgaagactcgagagtggcgtttgaaaacattcaaacctaaagatcatgtcagaggcccgaaatggcaacgacacgcccatctcgtcccacttcatgtcatttgctggagaatccgaggaaaactggggggcagacgtagcttcccgtcacatggatgcagaagcggagcatcagcaagaggaagcaagacagcagctaggacagacaacagagcaagcggacgatgcgactgtcagcgacgtcgcgacaagcgatgccatccagggagaccacgagggcaaatctggtgaggatgatcgtgggctgggctcctatgttggcgtcgagggcgagggagatggcaggccgagagacatggacagatatatggaggggacgggcgggataggggaaggcgacggaccacggccgcagccggaacccgcacggcctgaagagagggaagacgggcagcgccaagtagagtacggggcgtcaaaaatggagaagccgccagcgcagggattgccccagctcgatggtggagggcagcag

SEQ ID NO: 6872 - DNA, 700 bp, Nannochloropsis_gaditana
ctctttcacttccttctttcgccacatttaacacgatgtctcggcacaggtgcatagagcgttgggatttcaggtgtcgcacattccgcaaagtcttgtctactcgtgagctctgggggtctctttttaggcagctggggcgagggctcgcacaaaaggtgttcccacaagcaacttagtagtaaggtttattttcgtcactgggggagagagtgttgccatctaaaaggacggtaccattgcgtttgccagtatgtcgcacatcgaaaagccggaggagggcggggcagcaaaaggcccgacgagcgcccttccccctgcctcggactggaaagccgcccatacagggtcaagtgcccacatcgacgatgacaccacctcttacacggatatattggagacgcgtgcttcctctatggctctcccggccgcgacggagcgtgtctcgtttaaacgctacgagacagctgggtacctggaccacggtactttcgaccaggcaacaatcgacaccccgctggccgacgataatcgggggatgaaattactcatgaaaatggggtggaagaaagacacgcccttgggaagagccggggggaatgggttggtggtgccgttgcaactggtggatgcgggcctggggggggagggtctagggaaagggagggagtatgacaccactgccgaggaggccacacgg

SEQ ID NO: 6873 - DNA, 700 bp, Nannochloropsis_gaditana
tcgtgccaggcgtttccgttcgcctttgttggtacttttcttggcctgttttttaaaggccgagaacaggggaatcactcggatgagaacgtttcagacaaaaggggcactactgcagaacccccaaatcagctggggcgccattcgaaaatggcacaccgtcaatcgcacacggatactacgggagggggggttgcccggacaggagtcgggaggtcgagggatggtgaccaagaacagaggaaccacgaaatatcacgaccaaaatcatcacactcgactcccagtgcacgcacaggagtaagtccttttatcagcgtgggctggcattctttgctttcaacatgctgatttttacctccccgtaactgcttgtggctgtggggtcgcacagccagcacaagagccccccataagagcccgcaaactacgcactcacctcttccgcgacatccattgtccaccttccacgtcaattcgaaccctaagtagcaatgtgcgtggggttagcgcctatagctgagaggatcgttgatttttgctaaagaagagcaaacagacgaggagcgtatcgcctcctcaggctgccctcctcctgccctgtatctctgtcgccagtccattttaccatcggtgtactatcgacttacgctccttgcgtcataacttcaaccactacaatagttcggacaccattatg

SEQ ID NO: 6874 - DNA, 700 bp, Nannochloropsis_gaditana
ggtatgtcaaggcaagagcaagggcggatcccaaaccgcccgctagcgcgtgtatcaaactctctcgacccatggtagccgtgttcttatcgcaggaagatagaaaatagatggaacgtataaaagttgatacggtcagtgtgcttattcaaggaaagacaagggagctacgaaccaagtcatagcttcggccttgctgacgacttacctgctctccaggagacgacttctcattcacggggtggttaccctcaggcaatagcgcgggtcgcgtcacagcaagtttagctgccggagggcgcaattcatggtctctcaatgggcttggcatggaaagcactgtgatcggactgttcgactcaaggatttctgaagtcgcagccggctgcggaggtcgcacaggcatggggcaggtcttcacgccagcactatcctctcttgatgccatgagacctgtggattaaccagggggcttaaaagtgttatgtccaaaatgtgtacgtcccctagcccgtatgttgacttcggcgagcccgtcgagcgggaacatcgactgccctgccgaggcgagcagaaaaaagccatctgaccagtctgtctcccgtcataactacgcgaatgattgacatttcctcatgcttccctttgtacagagggcccttcctgccggcccgtggccggagcggaggacgggcgcatg

SEQ ID NO: 6875 - DNA, 700 bp, Nannochloropsis_gaditana
ttgatgccatgagacctgtggattaaccagggggcttaaaagtgttatgtccaaaatgtgtacgtcccctagcccgtatgttgacttcggcgagcccgtcgagcgggaacatcgactgccctgccgaggcgagcagaaaaaagccatctgaccagtctgtctcccgtcataactacgcgaatgattgacatttcctcatgcttccctttgtacagagggcccttcctgccggcccgtggccggagcggaggacgggcgcatggagacatcaggaggggctggggtcggcgcagtctccccactgccgggcccgaacactacgacgagcacgatcgatgaagccgcggaccatgaagcgtctcaccctccagtgacttttttagcgcctgcgcattccacggacccattgacctgcggctcttcgacccggaatggcgcggagcacggggcaggaacacacggctcagcggacagcaccagccccgaccgctatcaagtccaatttgtcgagatcgggacgcggaaattgggaatggttgtggaaaattgctcggacgtgaacgttgttgtagatctgcatcatgataacgatggtatgtacgcaaatatgtgttcaatcggggggtgtcgtggctatcctcaggtccctcagagcggacgtgcctcaagactaggacccttcccgccgattctcaccatg

SEQ ID NO: 6876 - DNA, 700 bp, Nannochloropsis_gaditana
cactagagagagagatgcctcctcctcctcctcctcctcctcctcctcctcctcttcccacagtcgcgcctgctttcgctttgtgtgacgttgctcctgtctttatgcacctgcgttattacactttgatgtagtaacgtggacgtttttggtgagttgattaaaatgcgcacaggaaaatggctggggaggcgcagtgtgcaaaacgatgatggtgtagcactttctttatcaagaaattccgccaacgtgagtacgcatcgcgcaatcacatagaaaacacacactattgtgtgctttgttgccgtgatagaaatcctggagacaggcaggtgggatgcggccgtgtttatttggccggacagagttaccggccccctttttgtgctgtgaagcgagcgaggcggcgacacagcatctccctccccccaaaacgattcttgttaactccaccttcatgcactcgacaagctcagacaatcaccacgttctctcaatagtgcggtattcttgcgattttaaaagccagcgtgcaacgggcctggatctactggcgcttgtggggagagctctatacggctcgaggtggtcccggcgggcaacgactcggcaggcttgaatcgtcccacacggccagaggcgccgcagcagctcctttttgcccgcccgacccgatatttggagaggaaagggtgacatg

SEQ ID NO: 6877 - DNA, 700 bp, Nannochloropsis_gaditana
aaagcactaaaaactgcagctgtgcccagcgaattaccggtattcccccttctccttctttgtcgctccatgggctctgtgtgtcgagatagttattcaggatggtacggtaagttgctgttgggagagttgaggcttcttgatggttgagaacccttgaagacagccgcccggccccatcgccggtacaatatcttcttatgtaaactgaaagaaacaatcagtcccagaaatgtcaaagacagaaaacacccacatacacgcgcctctgcgcggaccaaatcctagacattgtcaagctgcaagctttgagaaggtaaagctccgtgtccacacagtctgtgcaacgcgatgacgtcatcctttaggtcggcttctacctcgcgacctcgttggggagacgtgcatgtcaccgtctcgagcgagacaggagcatgcgctattgaggatggtgctttgggaggcacgcacgccttaaactgtttcttacggcacatttttcccctttccttcgtccagctcgtacctgctccatatcttgatcggctttccatcatcgtacgtcgtccgacctggacgttatcacgggctcgtgagacgatttgtcacgcattccgtttcctgaaaggccattcattttcaaaaaacaggcatacctgaggaagagtgtcaaggatacgcgtgttttctcgccataatg

SEQ ID NO: 6878 - DNA, 700 bp, Nannochloropsis_gaditana
cgaatgacgcatctttgattgccgcaggaaataatcaggctaatttatacgtctggcactatcaggaaggctctcccgatgcctacttcagccggcctgcacatgttcagcccgtgaaaacgcacgcacgattcctactgaaatgtgctttttctcctgattctcaacgcttggtcactacctcagcagataaaaccgccaagctttggaacgtaagaaagtgggaagttgagcatacgcttaaagatcatcagcggtgggtatgggatgcagctttttcagcggactcgtcgtatctagtcacagcttgctcagatcaccatccccgactgtgggatttgaggacaggagaccttgtccggacttatcaaggctccaacttagcagtaacctgtgtggcactgaacgatgcacagatatagagaggaaggagtggatgatgttgttatttatttgatgaatggcctgcggggcttctgtaaatactttgctcatttgcaagaagaggcacactgaattgccaaaagaaccaccgggcacacgagcccaagaaacacgaaaatgtgtgttgacgccaagcaccgtgcctgttcaatattttttactcaagttttaaaaggtgaaatttctttaagtctcgacaggaaaaaaccggaatatttgcaattagaacagccaggaggttatctgaggtttcttg

SEQ ID NO: 6879 - DNA, 700 bp, Nannochloropsis_gaditana
gcaaccgcaggctacgatcataagatccgattctgggaggctcctacgggtgtctgtgcccgctctattcgttatcccgactcgcaggtcaattgccttcaaatcacgcccgataaacaattcctggcagcaggtgggaaccctcacgtacggctatttgaggtaggtggaaatgccaatcccaacccagtggttagctacgaaggacatgtgggaaatgtcatggcggttgggtttcagcaggacggcaaatggctgtacacagcttccgaggatgggaccgtcaaattatgggatattagagcttctggatgtcagcgaacgttggagaactcaaccgcgacaagctctagcagcagtggggggggaggcggagcgggcggggccagtggaagcgggcaccatcatacctcaatggtggcagtcaactctgtagtactgcatcctaatcaagcggagcttgtcacgggagatcaagaaggtcgcgttcgagtatgggatttaggaagcaaccgctgtgtgcatgagacactccctgaaggtagcgtccccgtacgctctgtctcagttgcgaatgacgcatctttgattgccgcaggaaataatcaggctaatttatacgtctggcactatcaggaaggctctcccgatgcctacttcagccggcctgcacatgttcagcccgtgaaaacgcacgcac

SEQ ID NO: 6880 - DNA, 700 bp, Nannochloropsis_gaditana
cgtcacatacctattatatgactacgtgcgcagatgcagactcgcatggcacgtcgcgacgtttgcattttatttgacatatgtggcgttcttactcctatgtcatataccactcaacatatccatggtgtacccaggctcgagcgcgggtgtagacttcagatctgcggctctgatgcccgtattaatctgcattgacaccgccggaccccaatttttctacgcccaccgacacaaatattaaaggacaccttatcctgcttgagaaatgtcatcggccgtggtcctggcaaccgcaggctacgatcataagatccgattctgggaggctcctacgggtgtctgtgcccgctctattcgttatcccgactcgcaggtcaattgccttcaaatcacgcccgataaacaattcctggcagcaggtgggaaccctcacgtacggctatttgaggtaggtggaaatgccaatcccaacccagtggttagctacgaaggacatgtgggaaatgtcatggcggttgggtttcagcaggacggcaaatggctgtacacagcttccgaggatgggaccgtcaaattatgggatattagagcttctggatgtcagcgaacgttggagaactcaaccgcgacaagctctagcagcagtggggggggaggcggagcgggcggggccagtggaagcgggcaccatcatacc

SEQ ID NO: 6881 - DNA, 700 bp, Nannochloropsis_gaditana
gagtgtactatctggatatcaattacacgattgtagtcagttgcatgccttgaggaaggtaatattgtcgactcgcccataagcccttctaggtagcggcaacggtgcatgggcgatgccggcgatttgaaatacctcgtgttcccatttaccctaaccgtggacaatcacgtcgacgacatgaggacatttcaattttgacatatcataacgctatcctgtactacgaagggcggttctcctttcgagattattttcggtggaaagatttgaaaagggagagtgccgtgttgggtggttgtgatggaaaagggaacaattaggccgtcacatacctattatatgactacgtgcgcagatgcagactcgcatggcacgtcgcgacgtttgcattttatttgacatatgtggcgttcttactcctatgtcatataccactcaacatatccatggtgtacccaggctcgagcgcgggtgtagacttcagatctgcggctctgatgcccgtattaatctgcattgacaccgccggaccccaatttttctacgcccaccgacacaaatattaaaggacaccttatcctgcttgagaaatgtcatcggccgtggtcctggcaaccgcaggctacgatcataagatccgattctgggaggctcctacgggtgtctgtgcccgctctattcgttatcccgactcgca

SEQ ID NO: 6882 - DNA, 700 bp, Nannochloropsis_gaditana
atttcctgaagaatcgtactgctatcaaggttgcctagggaatgctccaagacgctggtacgagagcgtcagagcctcgcctcctgttggaaagattcctagcacctgagtgtactatctggatatcaattacacgattgtagtcagttgcatgccttgaggaaggtaatattgtcgactcgcccataagcccttctaggtagcggcaacggtgcatgggcgatgccggcgatttgaaatacctcgtgttcccatttaccctaaccgtggacaatcacgtcgacgacatgaggacatttcaattttgacatatcataacgctatcctgtactacgaagggcggttctcctttcgagattattttcggtggaaagatttgaaaagggagagtgccgtgttgggtggttgtgatggaaaagggaacaattaggccgtcacatacctattatatgactacgtgcgcagatgcagactcgcatggcacgtcgcgacgtttgcattttatttgacatatgtggcgttcttactcctatgtcatataccactcaacatatccatggtgtacccaggctcgagcgcgggtgtagacttcagatctgcggctctgatgcccgtattaatctgcattgacaccgccggaccccaatttttctacgcccaccgacacaaatattaaaggacaccttatcctgcttgagaa

SEQ ID NO: 6883 - DNA, 700 bp, Nannochloropsis_gaditana
tttagctgcaggctcttgagcgtcaatgaatggtaacttcgtttagtctcagaagggacctaaattcagataattagcatttaattttcgttgtcgcgcctcttcctgtctacactagtgcacaaatatagaaatgtcttttgacagaggttcggccgccatgaacagatcggatcgtggaggaggaagactgtggacgtgcacaaatttgaccacccatgcttgtaccaaacccattggctgttgccgcgcaatttctaatcctctacgatgctagatgcacacaacgtcatctgcatattttataacacgaaaagggtaccatttccccttgggaggggcaggcaacctcctcgcctagagaggcggggaggaggttgctctggcagagcaactcatggtattaagtagaaggtagattttttaggcttggagaaagtatcatggtcatgaccatgcatttgaccgtactggtgagggagaagtggaaaatcttgtttgtgaccgtacaaatcgtatatggtcatgcgcaaaccatctcggaggcacgtccatggcggcatccaatctatgccccatgctggcgccaaaatcacggaccacgtcaatttgtaaaagtacacaaatgtacagcagagtctttacgcaaaaataatctgtcccatttctcacatacccgacgcagattactctgacaatg

SEQ ID NO: 6884 - DNA, 700 bp, Nannochloropsis_gaditana
ctcacggacacaagtagcgagtggaagccgtgtggagacacgtatgatgcttcaatatgtcatggagcaatttcaaccttttctcaacaacgctagatacttgcaagttgtagttagtactttgcctggagtgggatttggtgtccgtacgtggcggggttgaacatgcgcgctgaactagttcccagcgctttttatcccctcagtatttttattaagatataaccccattaaatcatctcttcacaggccattcctgacactcgtctatcctgcgcctcttcccctgttgcatgggattatcgcgcgtgcgttgctgatggtctctagccctgaccgcggccccgcaaagcgcctctttttctcgtcaggtctccttctcttcctcaccaccacagtgctgagaaagacaggcatgcgaagtgcatcagctatactgaggagaggagctttcaattgtataagtccattcaacagcgctgccttcatcagacccgtgagtgtaccgggaagagtacatcgaaatttcattggtgggaatcctcacaagagcacttcaagtcctggccaacgtactaactctcttcgaagtacaagcccagcaaccgcagcatatccagaaatatcttatgcccaatccgatcaacctacggagggagacgatcccgtacccgcggtggctaattacacgcgcctcatg

SEQ ID NO: 6885 - DNA, 700 bp, Nannochloropsis_gaditana
atgctccacttacctccaatcccaaatacataagatatgccagctcccgtatgtaggcaggcggataaatctgcctgcccccccgcaattgtcgccgggatgtgctgaaaacgggatccaccatcttccaacactctaccttcgcacgaagaatgccggctgaggcatgatctgcctgccctgaaatctccaaagatcctcgaccattagcctgtcaaaaattgtgtcctgtgatcatatcatttgagaattaaaaggcttacaaatttcgtgcgcgaaaagtaaatgtacccagggtgagacctgcaaaacgtgctgttttctgctcccacgacggcacaagggagctgggcgattcgatgattttgatggaaaagggtacggccccgctccgcccgctgctgatgacgtgggggtgtgatggaaacgaccgcaacctgcctttatgatggaaaaggcctcaaccctcggtgccggattctcgcgctctcatcatggaagtaagtcaacgacagacgactgtcgctccggcgggcacacgcacccagcacacgccgcctcccgtgcttcattgatgcattaccgcaatatttcatgtgtggtggaaatgtagaagccactatgcctggtggctgtccatatttgaagcttaagtcctctatcccgcggtatttccaagttcaggtaccgggcacaaatg

SEQ ID NO: 6886 - DNA, 700 bp, Nannochloropsis_gaditana
tcttccctcgtcatcgccaagtcgggaagcgcctcctctctggctgcccatcagctcgctatggcgctctggctcctcccttccatccttctcgactcgcttggtgagggaggaaggatgagagggaagaaaggaagggagggagggagggatacaaaagtggatgatactgtgcagggtagggaggggtaggggttgaaatcggcttgattaacggaagtcgatattcccgaaacaggcatcgtggggcagggtcttgtggctgactgtctgggacggggacgagtcatgcgtgcgagaaaggtaaggcctttccccctcccttccttctcccctcatgtcctctcagggtccctccctgctgccctctgctcaggtgggaaggcggctcttgcaatatgggagtgcgggtggatccttttttggcattatttacctgctagggggtgcttcggtgcacagctggtctgttttcaaactggacaccgcagcagccctgaaggtggggtcagagcaggcgagagagtaggggaaagggaaggaaggaggaaggaaagaaggaagaggagccataagccatgctgccagtcagtgattggaaagacgtgagctggcgttaagctcgcttatttcaacttgataccagaggaggacgggctttccacaattttacatcctcttgctttcctaggccttcatg

SEQ ID NO: 6887 - DNA, 700 bp, Nannochloropsis_gaditana
gaatggatgagatgaagctagcctcgctcctgccagtgtgcttgtgttcgtcacgctaatcgagggctgtttgatggctcaaatgacccaaaaccaacgaatgtggatgaatatcgttcctaatggcctttttgtgtgtgcaagcgtatgctgccgaagggaatgggaagaataggtctaatgggacactgtggtaagcggtagacgcgtagtggagaggatgatatggcccgcccgtagtatcttggctggcccctgcttttttggtggagagaaacgggggagcgcatttcttggtttgtccacgcacgtaattgttccgtatggatgcaggtagacttcttgaggtgggagaacgagagtactggctttgttttctttgctggaggtgatgacccgcgattgggtacgaagcatgttgggatgtgagtggcagtgggggaggtgacggtgaaagatagtggtggtcaaggcacattgcgaccaaccgagctttatcttgaaatgaaccaacgtatcaccctgacttgtcattgctcgctttgcatgtccatgaactcggggcggattgacagtttatcattagtgggcgggttcgcctgcgatttattcgcgacctacgtaacgcccggctcgtaggtggaaaagaggtaaatatgtgctcaatctaagccactgctatctcaacaggagcatcatg

SEQ ID NO: 6888 - DNA, 700 bp, Nannochloropsis_gaditana
agccaatgcctctggtcccacattattctggaagcttccgtcttcctttaaagccatgcccgcggcgaatgattcggccagaccgggtgtcgggggcaggcggctctctctccgatccgcttggctctgattgccatccatactaaatctgccacccccattcccacgcccgacacctccacctctcctgtagctacgaccctgtccacgggggccaccgcctctacggctctccggttgctccaccttttcgtgtctctcgttgtctctcctccctgagttactgtgatacccaccacggggcccaccgcctccttcggtaccaccgacgcggtcgctttctttcggcatgatgaatcagaacgcgaacctcctattctgcattttcgaccgacatagaaatgaaggaaatgggttttgggagataaaatatatattacatttgcgcgggatgacctgtgcaatggacgtcactcgccgcagtatcgcgcaaaactatgactctacccggggctgcctgaggtcgcattcttcaacgccctcgcaagcattgacaccactttcatgttatctttctgggaaaatgtaggctgtcttctgcggggcactgctgccattacagccagatcaactctgataggggggcgtctggcattactctgaccgttctaacctccccaccagccccaacttgacaatg

SEQ ID NO: 6889 - DNA, 700 bp, Nannochloropsis_gaditana
cgtgctggtctcctcatgccatcctacagccaatactaaccgcggcttccgcaaggtgtcaaccacgtgcccgcgcacgaagtcgtacaatttatcgaatcgaaaagtaaatgtgtcctcaaccacgtcgcaaacttcggcgtcgctcatcacggtcaggtgctgagtctgagaatggagaggagcagtcattgtgattggggccaatggcacgccagccctccacgatgctgctgcatgtgttgggtttaaaacgtgcatcctgatgtaagtagcttcatggaatgcgaaatccttacaagaggagtgctcatgcggagatttcaaatcatacattacaataagaacttctccttgagtcagaacgatacaaataatgcgcgtacttggtgagattgatcctcaaaaaaagaacggtggccagaccaaatatcctttctgtccaaaaagaactttgtttaccatcgtcgaaaattaaatcctcacagccgaaccgccaaacgccttcagtgtgcggtgtaaatgtgtcttattaccaggtattgttgaagtgggggggacgctcctccctctctccgagcacgccggctcgacaatttttccctcaaaccaaatgcactcgagcatacattacagacatgaagataccattgcgtaaatgacttatatcgccaccccacgatgccttttcccgccccag

SEQ ID NO: 6890 - DNA, 700 bp, Nannochloropsis_gaditana
gaaccgatttttatcccagataaattcacagcctacggaaaatggatggatgggtgggagacacggcgaaaacgtacagcaggtcacgattggtgtattatcaaattggctttccccggtcgcattttgggcgtgggtgtggacacctccttcttcacaggcaactacgtgcctcgctgctctatccaagctgcctcatacattgatgacaacgaacccatcgcccttcaaaaactggctgcagcacgcactgaggttccaggtggagataaaataggcagcaaggcctctgaggaggagatgaccttagcagcgagcgtccattcggatagttgggaaaccattttacccttcacccccttgggtgccggttacaaagatacgtgccacaactattttgccattgaagccacagagcgcttcacccacctgcgcctgaacatgtttcccgacggcggcatcgcgcgtctgcgtgtgtacggaatcgtcgcccgagcctggcatttggtcccggccacccaggtcgtggatctggcagccgttgagaatggcggaaaggccatcggatgcagtgacaagcactatggccaccctcggaacttgatcaacccggggcgtgggatcaacatgggggacggttgggagaccgctcggaagttgacccggcctcccgtgctcgagcctgacgaaggaggactta

SEQ ID NO: 6891 - DNA, 700 bp, Nannochloropsis_gaditana
acgtcgcaatttgagctctgccgtggctttggtccacagcgaggacaacttgaggacctggggacgtatttgccgggcacggaggctggaggaaggaggcgcaacaaatggtggttgtacccgtcgggccgcaaaaaaagttcgatgctgcctctgtaaacatctgagcatgctaatccctgtgtacgcggttcaaaagtcgttgagaacgtctactgtgagccaaaatgtatcaggcaaggccagtcgcatgctttccacgagtaagcgaggcaatgaggtgaaatcgcccccaccgccagataatgtgcgtgccaaaaaacaggctagctgtccgcgcgacgcacatgtgcggccatggagtgctatctctacgacgacgataatctgcccagcaagcggaggcctcaagtatacacgtgcgtttccagggaaggagtatttttttttgggggtatctcgcatttcccctataaatctcatttctacatgttcaagcccggggcgacatgtccgtttttcaacaggtcttataaataataccgtgtacgccgacatgacctcatactcttctcgaggctgacattgtctattgttgctgtttggtagggtaaaggcctgtgcttttgtatcaactccgtgaatgtgctttgccaatatcatcaaatgggcttcaataacctcccctcgtcccacgcag

SEQ ID NO: 6892 - DNA, 700 bp, Nannochloropsis_gaditana
ctccaaaactgagccccctcccccgccacgctttttccctgtcacagcacgcccgctgcccatgttccacacttcaaagaaatgtatgaaaagaaaacctgcggctgcgctgtggggtgtgatttcgaggaataaaaataaggtgaggtaaagcgggagcgatcaggcgctgtcaaattaaggagtggagagagagagaacgcccgcccattccatttccacgagtccaaagtgtacccacgccatgacaaagacaagacgagccattctcaacagcgaaatcacacatatggtcgggtatcccacccactttcgctttaagtcacatcttaagttccggcggcccacgatttgagctcgcccagacgaagacagcgaggctcgcctatgcctgttggcggctttcacaacgtgcaccagcatggcacgtacgtcaggtgcaggcatcgatgcaattcagggagagggttccagtaatgtttaggaaaggatagtgggcgcgcaggaaccatttatctggcgtgttcgctgtcatgggttttgtctgggaagcttcctctctgcttatcctgtttctagcctcctctcttttaacccacggcatcattatcatcttttacactgtatttgtcctataacaaaacccattccacgcagaaaaagccgcatagattgtgaaaggtaaccaaagtgtcgtatg

SEQ ID NO: 6893 - DNA, 700 bp, Nannochloropsis_gaditana
catctgatttcaacaccacaaccaccggcgcaagactacaaatcaggggctgagacaaacacaatcagagacaggtcccacccctcatgcggccggaaaatggggcaagaggagcggatgcagagacggagggaggggacggcgtacaaatcgggggaacatgtctgagaagggagcgaggaagcgaggggagcggagggagggttgatgaagcatgtaagaatgggacaaagacgaacccgggcgccgtcaggtccaagcatgcactcaccaactactacaacgagtatagaatgatattctgggcatttcacgccatgagtgtggctttaggaatcggcaacggagagaccgtcctaccattttccttcccctgtgcccttgccaccgacgagggttgagctcgaaggcaaaaatatacactcgtgattaccccatacacacgagaagaagaaagcatctaccaccataggtgtaggcaggacattttggccgcggtgtgtcttcacgagcggtgtcgtgaagactttcttgtgttcttccgttctcctggattttgacatgattttttatgactttcaaaacagcaggacggcagcagcaggcaggtcttgcccgacaaatgaaatcttatctcaggcctcgccatgtattttcctctgatctcccttcacaggacacatctttagtccatgcgatg

SEQ ID NO: 6894 - DNA, 700 bp, Nannochloropsis_gaditana
aaatggacgctattccaaaaacataaaggtaatgatacaaccccacgtaccttggcatttacgcatcccatacttatttgtttggcacccgttggtgtgttagtgggtagcgcttgttcttactttcgttcctgaacgcctgaaagccaggaagagaggcacgatttgagtctttataggggtcctccccggccaggcaacgcttctctcccccagctgctctcgcaaaatttctctgagggctgtcatagctctgcgcatccccttatgtgacgtcgccaccggtagatttcacgcggacacgggcatatctcccatgtgcgggaggaacaaatgacgatggggtcgcattccatcatagacttgggggcctctcccgtcatccagctctgcgtccagccttccggcactttgtcttgtgctcgtcgagcatcttccttcactccgacgcccatggttcgcttgcgcgcttgcgttcgttgtcccttgggtacgaaggcgatgctgttgtaatgaacgtcgataccccggtggagggatgggcgaagtttgtgaaagcgaggagaggtcatatgcagcaggaagagagagccaacccgccctctccgattcgagatgaacccttctaaagctgtgtgtcactcatgctcatgcatttccctacaatgcccatctataatgcgcgaatagagaagagatg

SEQ ID NO: 6895 - DNA, 700 bp, Nannochloropsis_gaditana
aataatagagatgtgccctcagggagcaatgatcatgcacccaaacgctcacataatccgctttgcgatgaccccaatttctcccgcctcgtcatgcaagagcgatatccggaaatcgtggtgtatcattgcgatgttaatacaggagtagccactgtgctggcgtgatgtgacggagatgtgatcctagaatgtgtaaagaatgaaagctaaacaggaaaggagtacaagggtggcaatcataggcaaagaaaaaaaagtatgtatggactgaaggcgaaaaacaatatttccccacttttcatggattgattttttgatttcttattataaggcatgctgacttcccttatgatgcatgcacgtatcaaaaaaatgctgagggccgcactctatcatggttttagacacagacaacctataaacatcaaggcgagtagcggtgaagatcggatcgagggctggagcgacgacagggacaagggccaagcaggaaaagctgtgattataaagatgttttttgttgtccttctggctttgcgtcctcgtattgttgcggtcctgtctacagtcgacgaccttatgcaaccttcccttatctccttgtcctttcagggtcacttccctgggtgtgtttatcatcacatttcccgcttgaagtggtctcgttgcttcttcgaggcggcttcgggccaccatg

SEQ ID NO: 6896 - DNA, 700 bp, Nannochloropsis_gaditana
gccgctccacaaacccaagctgcatcccccggtcaccgtcgtcgtctgatgaatcatcactactcctaccatcttcacctatacagccaactttccttttgatttctgtatccgccaccggcacaagaagtggagaagtagacgtaggagaaacatctttgccccgtcctgatcctttagcctcacatcgatatttgctatcggtacccgaattccaaccctcttctttcgtcagcatccttctacaatctaccggtattttgatcgttgaaggagtcataccggcttgtgtctcatctccgtccataatgccagtgggctcgaccaccattatcaaacagcaagatattttcttttccaagtgactggccgccgcttatctggaaaatgttatcaaagccagctccatttctgtacaaagttgacaaaggatgttgagagaagctaagacatacttcacttcaggaaacttggcacgtcaatggcttccatccaacgtcgctaacctcctccctctcccgggaagacaagtcagttgaagttttggtgggttcgaaaaaggctgtctcgaacaaaggcgtccatatgtcactcaaataacgatggcaaggcttactatgatatttaattttttttgctttattataagacctcaaacaagtcacaactccttttttgcaattgctttggattagacatg

SEQ ID NO: 6897 - DNA, 700 bp, Nannochloropsis_gaditana
gcttcttcccaatccccacgtccgccaacttaccccggcagagtctcaggcgtcacgaagtgcggcctacccagcgcctgtccagggtacgccgcctcttgtatggcctccttgaccaggagctcgggcgctatgctgtccaaatgaaggcctacgatagtcttggattcttcgatatcctgcgcgtctgagggggtaccaaggaaagccagaaggatcaaaaacaggaaacgaaatgagtgctttctttatgcagcgtaggtttccttgaacatgaattctcgcccacgcccgtcgtaactccaatgccctctacttccgtgtcgtgacccacctattttcggattgagaactgcgtccccgaacatctcaaggattttagaaagtgtcagccggaaaattgccctgtccaatttaagttatattttctgggacggggctgcaattgccgagaagagaccggcaattgaagcacgcctgagatcgagatgacttgcttgctatttcgcacgacttgcaaaaggaaaccgaacgggaggaattgcatgcgatgttttattacttcggttatttagcgctttgtattgtgcgctgtgtaatactgattaatgggttaaaatcaaacttattaagatgctactgtcgtacgctccgtcttcgagaaacagatatattcatttgtctccgtcggacagtcatg

SEQ ID NO: 6898 - DNA, 700 bp, Nannochloropsis_gaditana
cctacactctggttgagatagattctaaacctcttgacatgcatgtatggggtgccaaggctgaacgactgtcagcgtctgcgttctttgtgcttcatacctcttacatccgggtatcgcagacttcaaatgttttcttcgaatgcccttttgcaaaaaacagtacgatagaaaccttatattcatgccaacattcctgacaggagccccttacacgtcataattgaggaactgacgaggattcgaacgaataggctgttccaaaccgacctattgtggccttcgggccactccaccgccggggcaaggtcttcgttgtcagaaggcagacttcgcaaaagcaggagtaggagtgttattcgtctaccaacttatatttaagtttatttacgagaggaaggaaacaggaacaaagggcggtcgcacatttttgggagcacataagtgtcaagactagcagcgaagttggtggtgaagcatgaagcgcgaagtaaaaacccgtacggttgacatttggagagcccttcccgtcgttcgctctcttgaagataccgaatgtcgcggaagcaatggaggagtgggcggtatggaggaggacgatgagaatggcatgtcccaacaagcccctcctacccgcacacgaggacttgagcgatcgtcgagcaccagtgcagtaaattctgggacaggagggagcatg

SEQ ID NO: 6899 - DNA, 700 bp, Nannochloropsis_gaditana
cttgagaggaaggagaggaggagaatgacaaggggaaaaaggacttgtattcttcgaggatggtggaactgatgtagttgatccatcacggcagtcgacgtcctcagtcggagcaggagagtgctatcaggaaattgctgggatatagacggggctgtgaaggggaggaggttgccaactcgaagacctcgagcctgcgggtggacaaacgggagcaaaggaagaaaacgggacgggtgagataaattacaaccgtccacaacccatcctccttcacgcatgtccacgtgcgaccagaacctacccttcaactcttggttcgggccaaggtgggtacgtagttgacctcaagggggggctcgaggcctcatcctcccgggccggggtcgaccccgcgagaaccacacatcgcccccatcgcctgtgaccggcgcgcggtggacggaggcagaaggtcagacgtgtgggatgcgtcgtaggaccgagtggcctgggtttaaaggctcgtgactggttgtagcttggtggctgtcggccgtttgggtgtaaatttgtgttcgaagttgtgctgagaaactcacttcctactccaagggtagagcagatcaaggcgagcgaaactctccatcatctcatctggcttgtgcactctctcttttctatttacatcgcaggagtatctgtcgagcctaccatcatg

SEQ ID NO: 6900 - DNA, 700 bp, Nannochloropsis_gaditana
gcgggtgggaggtgttgcttgagaaacggatcatggaggtaaggtgaagtcgccccacaaccccagagcttgtgaatgctcaacttttttcgtctgtatttttaggcgcgcgcggtagagatgcgcgtcctcatcgccgccgggttgttgagagggatccacgagggaatctccttcttttcccctgttcttgtcggcgccgttaccttcttgacctactggagcctgggtaggcagttaaaagctggccaagtcttctccgcgcttaccttgttcaatattctccaggtaaagctagctttgtaggggagaaagcgaagcaaatgaatcgcaagcagcatctcatattcccgtctcacatgttattgttcttcttactttcttcttactctaagtgggacgtggtcaactttggcggcaaggccatgcagagcttgggggaggtgtgggtctcgcttggacgattggagcatctcctgcgcatgcctgagcttccttcctaccgcctcgaggtatcgctcatctattttcgatatcatgctcttatgaataccaaacacgtgtgtaatccctcaaatccttcgtgcaggtctccaagcctccgtcctcagattcctccctgagcccttccccccccctgtctacatcccttcctccccccacccctgtccatgtgaatggcttgtccttcaactggagc

SEQ ID NO: 6901 - DNA, 700 bp, Nannochloropsis_gaditana
gattccggaaaccaccgatgcacttccttgggctctggggatggaaaaaatctttttctccagaggccaattgcttctgcgatgggcatataatgaggtcacgcttggcgtcgcgtagccacttgtgagggtatagtttgcgtgcattctacgtgttattcacccattcgccctggccgttgaaatgctgctaagcgaggtttgacgtgaattccgcggatcgtcaaacttaccctcgcttcctctccaataacaagacatttgcagcaattttttttcgattactgcctgtacacctttccaaatgcgaaaggaagcatttaatttgtggcgtaggttgcccatatgtatagaacaaacaagttcctgtcgacctcctgtccgatagttgcatcgcacaaacaccaggtggaatggcttcttctcttcatgtgtgttataggtcccgttttctgcttgatcagcctgtgtgactgccttctcatcccttctatctgtcaacaggcgagacagagtttgaacttgtcaagctcaaaaggtctgaggagtggtggggactaaattaccgtggcaacttcaaggtcttattgttgacctcttttgtcgtctcaactcgtaattggatgccatcagacgccatccaagataggccctatacgtgacaaattatctggctagcagggcagggttgtaaaagatg

SEQ ID NO: 6902 - DNA, 700 bp, Nannochloropsis_gaditana
gtgctggctaatgatgaccgcaacgaccttttcctccttagccaccgtgtctgctgtcaaaggcatgagtggtgtctcggaatggttcgtgcacattttcctgcttttgcacacaaagctttgcggttcctaacgttttaaattaatcttttatgcaggctggtgggcatgtcccttatgtacgtgttgcagctcgctgctatttttcaatgggcaacacgccagagctcagacgtagagaaccaaattgtctccgtcgagcgaatcatggaggtaagtacgtccagccccttactttcttttctctcaatttcttgcctgtgtcttcctgcgtcttaagtggctttgagaatttacttagagttccattcggacatatatatgtatccggcttcctccctcctttcagtattgccagcttcccccagaagctgcgcttgactctacccctgggcgagcgccacgatcgacgtggcctgagacaggcgccatcgtagccacgaacctccaagcgtcataccgaccggtaaacatagaggactaaaagtagattcagggtggaaggggtcgaaaaatgattggtgcacgttaacaatactttgctaccccgccagcttttccatgatgacttctgctgaacatattgctaaatttatcatatctgctattgtagggactcccgctcgttctgaaagggatg

SEQ ID NO: 6903 - DNA, 700 bp, Nannochloropsis_gaditana
gttgcatgtatgagaccatatcgtttgtatcatgcttttctagccactagcgtgacagtacacccccattaacattttttttacctctagcgaagcgctttttgtgcggatttaggcccgttatgacaaaagtgtcatcgaacagattgtgcgacatggctttcccctgcaagtgttgagatatacgaggatacctgaccttccagcctgcttccaaaggcggatatcgcaataagtgtgaccgccgggtctcgaagcgaggtccgtcactacggtccaatatcgctcttctctggaagacgaaggtatatgaatgacaatgaaatgtaatgagtaaatgtcccatgtgctgcgaagacattctcgtggagtgcgcggccatggtcttgcactgagagcgtcgattgcgccaaaggagggaaagaacactgtcgccagctcgcccgtctggctttcgcaggccgcgtgcagaggtttcgacgcggacagcatgagtggggggcgatttgaggggacgtgcggcgtaaagactgtgcttggtgtctttctttcgacgtcgcggtccttttagggtgctggggatcggatagtgatgctttctaaccgcgccgggcgcaacggaacactctctgaggatgatcgcctactctctttttctgcgctttatcacaggtgaagaaatcaggaaacaagaaaaatg

SEQ ID NO: 6904 - DNA, 700 bp, Nannochloropsis_gaditana
ctcggtcatcacaatttcaattatgtcagctgaagagtaaatgcaactttaagggcagcacctccctctcttcatgtgttcctgccattggctttcgtcccttgatcgaaaccacgaccgacctacctctacagggtggcggactgaggctgcgaagcggcgctgagaaaaaagcgtggacggcaggcaggacaagcgcgttgaccgccacccatgacgaaagagttggtctcctcatgtgtgctgccctgtgtcgggaggagaagtgggcgtgcggaagggatgaaaacttgtcctggtttccctgccagactacaggatcgacaacttcagcctcgagacgggaggatactggaggcagtctgtcctagtgggggctgtcgcctcgccgggccccacgggacgctcgctttcctcgaatgctactgcatgcctttccatcgcgtgacctgctggggataaggatggagtgtttgcgcggactaatgctctatgacggcaggaataccgtcgtacgtatcatttgatgtaggcagaaagccaacagagggaggaggtccctcgggtgctcatttccttctcctttcgatggcatgtccctcaggctttattagggcgacaacgtgcgtccacgtctatcccagcatcgctttcaagctgctaaagaaagattgaaaaacaagagtctacgagaacgatg

SEQ ID NO: 6905 - DNA, 700 bp, Nannochloropsis_gaditana
tccaccaatgcatggcactcaggtccagcatgaatcatactgtcacgtgcgacgcaagcagacgaacaatagaaggtcactttgcaagctccgcacacgaagatctgctcggtacagacatgaagacaggctgcacaacatgtattacgatagaggtccgccactacggcggcaaagggcttgtctcgaagaaatgtcattccggggtttgggagcggcctcgtggcaatgacatgtcggcccctgccttcacccgaattccgcacgcggcaacagttcgaagccgacggaggcaataccggacaccctgggagatcgtgttccatcgtactggtcgacaccctgtgggagcggcagtgggtggcacgcagggttggtgatttgtggttgggatggaggggtgggcggctcgatgtcctggaacgcctcgcgtgacggcgagaggataccctgtctttgagcctctggatggacaatttcgcgtcgaggggacggctgtggcctggatgctttcgtcctatgggagtgaaaatgccatgggttggtgatcgtgctttggtctttaccttggtccattgcaggctgagctgacaacgatgttctcacctttccttcgctacacatcttgtttgctgacttcctcaatttcacaatacacatttagacttgctttttattgtcattttgcctttaaaggatg

SEQ ID NO: 6906 - DNA, 700 bp, Nannochloropsis_gaditana
taacgaagactacggtatttctgcctgaaggattgaaattccttgtgtgttcttggccaataggccggccagtaggcctgccactgcgcggaaacattctaatcaaaaaattgccaggaaagggaaggggatgagctgtcacgcatattggaaacttcgtatggtacgttaggttctcatgttggccctggtgcatgctttgactcgcaaacatgttcatgacaatctcctgtcaaacgtctggattgttgtccagcatggactgacggaaagtgaccaaaatggtgccgtagacaaatctccattcatccgtcaggcatcagaatcgggttgatctcgcggatatatatatcaacttggccttcaaatgccggtggcatgatagccaggggcgtggtctgccgtggcgtgcagtgcgtggcgtgggagcgaaatcgaaaggcaaggaacctgcgcatgggcctgtcgtcctcggcgtttcggaacttcgccgacatgcctctgccgttcccacacccctggctaggcggaggacgatctatggagttaaactttctacttcctgaccctgtcgacgtcgttgtcatataaaatgtggtggattcgccctatgttgaatcccggcgaaaacctccgatgacagatcccggcgaacgcctccgttgaccaccgtgtggcacctaatgtatttgttccaact

SEQ ID NO: 6907 - DNA, 700 bp, Nannochloropsis_gaditana; identical to SEQ ID NO: 5487

SEQ ID NO: 6908 - DNA, 700 bp, Nannochloropsis_gaditana
aatacatgcgtgagatcttcactggcgaaaattatagaaggaagcaatttgcatgccctgaggagaggaatcaaggctgaatctcgaagccactcggacttatgactgacccgattcctatgaatacgattttcctggtaccgttggcgtgggcatgcgttcagctggcgcccaaatgccacagtctaatcaacagagtgattcagtaggcacatgaaagctggacaattcaccgcgactggtcgtaaatcccaaggaaggcgaaacgccgcctcgaaaagttcctgatagaacacggccgtgcgccgtcacgccgttgctctggtatatatgatggattaggacccggggcgaggcgggcggcgagggccgcccaagggggagaaggatgatatgatggaaaaggaccttcgcgcctttttctgcgcgttctcggtagcatcgcgcttgacttgaggacccagccacacacaccacacacctcctccttgtcgtttcccgtcttaagctttcctgtctttctatttgaccgttcacggcgaagagatggaagagacagcatgaaattttcaatgttaccagcacaatctttgtgggtttcggtagtcttgttccattctgattgcgaattattatccggactattgccttcaacgaacaacaacagcaagaggcatctgcaaggaacaggggctcgatg

SEQ ID NO: 6909 - DNA, 700 bp, Nannochloropsis_gaditana
aagcccagcagcctgtgtgtcacccgcgcaaggtgataaatttggtgactgtgttggtgctcgccatggtgttctgcatcctcatcatgtccgagctcctggggcagccctaccagcacgcccctttcatcttctactttctgctcttggccgcagtcatctacccatcggacaccactttgatgttcagagagcttgccctcttatttgggcgggtcctttggctggtggtgctcccggggaccgagattcacttcctggaagtgttggtcggcgacatcctaaccagcctgtccaaggttttcttcgaggtcggcctcacctgcgtggccacactcctttctttgtctccggggctcttccgcattgtctcccccgacatctttcccacccttctcgcctccacgccattcatcctgcgcattcgccagtgcgtggtacagcgccgcggaacctcctctgggaaagcccgcttcctcgtctccctgaacatcctcaagtactgctcctccatccccggcctgtggctgccgcttctcctggcccctcactactccacctaccagatcgagcgcgtgctgctggtcgtccttctcgtcaactccctctactccttcctgtgggacgtgatcatggactggggcctcggccacgtaaagctgaccggcgcgcccaagaaaggcggcgggggggccgtgcg

SEQ ID NO: 6910 - DNA, 700 bp, Nannochloropsis_gaditana
agcgccccgttcgcgcaatcaagcagcacaacgaaggcttgctctttcagtaaactttcgttgtgcccactgcagtccattcgcaagactttcggttcagaataaattatggaggttggtgggggcgagaccgtggaaagtgtgctgaagcgattggatcagaaaagcgagtacgcggtggtccgaggtacatgtgttggcatcctgttcatctcgctctgggctttgaatctgcatgtctttaaagttgcccacatcgatatatcgtgcatctaccccgctaagctcgtcagcgcgggggggtatggtgggagcgggaaaagcgaccatggaagcggctcggggggcagcagcaaagacgtcggcaggactacaggcagcagacggtcgccctcggccgtgctccagaagcagcagcaacaagcccagcagcctgtgtgtcacccgcgcaaggtgataaatttggtgactgtgttggtgctcgccatggtgttctgcatcctcatcatgtccgagctcctggggcagccctaccagcacgcccctttcatcttctactttctgctcttggccgcagtcatctacccatcggacaccactttgatgttcagagagcttgccctcttatttgggcgggtcctttggctggtggtgctcccggggaccgagattcacttcctggaagtgttggtcggcgaca

SEQ ID NO: 6911 - DNA, 700 bp, Nannochloropsis_gaditana
caggagcttggggccgggaaagcgaaacgagcaacgtcttcgtttatacccgacgccagtcaaccccacgcgcactcgcctacgacgagccaggagggacagcgaagaccagatcttgttcctgcacacgtcccactgcggatcataatgggagaaggcgggggactccttagtgcgtgtgtttggttaagatacgcactcacgttgagatgcagggctccgcttggtttctgccggcgcggcgtcggagctctctcttctatttaaggggaagcaggcgccaaatattgtaatccaggaacatcccttccgttcacgtcttctctaccaatagaaggcatatggtctgccggaaggcaggttgattcagtgggtaccgcccgcgctgcgcgtccactgtgaaactttttttcgttgaggacacgctcggcataacccctgcattggctttactccaggcattgcaccacaagctcacggaaggaccgcggtacttccgctacctgtccacttcatagtgtcgatttcatagcttacttctttgcccacgtctaatccctcaacataagttagacagacgagccgtgtgaacgcaggtggcgagacttcgagccgctctttgccaacgtgctttggacgcgttcgcgccctcgcggaggcaaatagaagcggaaggtgagatcaccatcgcgatacaatg

SEQ ID NO: 6912 - DNA, 700 bp, Nannochloropsis_gaditana
tatcgccacgacaaagtcttcgccctaataatttgtaaaaagaatgcacatccatgggatgacacggctgtcttgcattcaggagcttcaccaagttgttcgtttcacgtcacgtgtcgcttgtagtcgctggtaggacacccctatcgcccgagaccccacggcgacacgggaaaaggactgtggacacgaataccacgaccacgcggtcatgcatggatgtgatgatgcgcgcaagcatttcatgcgcccacagggtgctttttccaatgtgctgggataagcgcgttttgattctggtgtgttggtcgcggcataagatgacaaacaaattcgtaccaatttgcattctcatcctcactgtctttgacccatcgcctggtacgataggggcacgcccggcatgcacatgtctcatcggaggcaatggcagcagccgtggtggtaccgtgccccttttttcgtgatcgctttggtggtcctgacaaagaacatagactctgtaattgctgcggagaatattgccgtcccagaagtcagtaaatcagggcaggacgtgacacagcccaaagctggagaggctgcacaaagagacgccagacatgcatggatagggcacgagccgcgacatggagacgaaagtagagaaaaaccaggcgacaagaccagcgacctggttgcggaggctgaagaggaaatg

SEQ ID NO: 6913 - DNA, 700 bp, Nannochloropsis_gaditana
agaggcgctttggacggcataatttatctgtgttaacgttgagcaatgtgaagatggccgtgaaattattctgcaagaatcagccggtagattcatgttcactctggaatatatgtcgtctcacgagagcatggggtttaatgcgatgtggaaggtgagctcacgccctccccatctcgtgtgtttggtggagtttggataaaagtcttccgaagggcatagagacatgtggacggtggcaaagtggcatgagggagtgacactcatcattgtccctcttttgttgtgtaaaaaatgctgagcttgtttgagggtgagctctcgtcagacaagtcgctagtccaagatgggcgagcgggtttgaaagcatgacaaaggagggaaaacccagaggccttctgtgcacgctctccctcacagatcagtaggctataaaggaaataaggagaacgaaaatgtaaaaaaggtggattcgttgctgaaggcgaggtttaaagggccctaggaggaggtggaggctggccgtgcgtggactaagacaaggctggaggcaccctcatgcctgctggaccagtcaccacaaaccagcaacgcgttatccatgcaatcatccagcgcttgaaatggccttcttcgtttctatgatgcacaggggctccgcagaagtacttcgacgttccgagtgccattttccgccatg

SEQ ID NO: 6914 - DNA, 700 bp, Nannochloropsis_gaditana
acaaggaggaaggctcgcttcaagtagactctgagcttttcttgggcctcaagataatccccagacgcgtcataagcggccagaaccctctcaggagaaagcgttgcggtgtgtgcagggtcaagagcgccatctccccccatgatgcacagaattagataagattttatcctagcttggggcctaccgtcctctcccacgcacaagtagctttggtcctgctctctctaggccctagagatctgacagtggaatcagtggcagaagatttctgatgaggagatctaggaaggtcatgaaacaaaggaggaggattagatgcacattgcgccaatactgagcattgggagtttctgtaggacgactggcagctcctcttagtagctggctccgatcccgtcacgatcggcattgccccttgtccgatgcctgatgtatcgactcacacgcactgcactggagtcatcacctttacaccagtcaagcctgttcgagcccctctcactcgaacactggagatgcgtgtttcagagggaggtataggcacgtcagggtatcgccgagcgccgccacgaagaccgcgagcagaacaagcgaaagcttctgccatatcagctcgagcacatggcccgcctcacctccatttcgacgcctctgtctccctcaggaaagttgccggggccattgaaagcacggcatg

SEQ ID NO: 6915 - DNA, 700 bp, Nannochloropsis_gaditana
ccggtcttgtgcattgtctgcgccctagaacagtcgtggctaaatgtgcgacgggcgggcaagacagactctctggcctggaaaactctggacgatgatgctaacggataggcctttgggagctctcgaaaccgcagggaaagcaatgcatcctcccgcgcgttcagaccccagccctcaaatcatgccctgtatgctcatgaaggaagaatgtgagtgccgagaaacgcctgtaccgtgtatttgaggcggaaagaataagtggatgtttcgcctctgtgtagaatcaaaatcagggacggaagcacggcgctcgcccggggagggtattccgagtccgcgatcgtgcgtctgcgaaaactgagcctggcctggacagcgctctacttggctgcatagagggcttggctgaggaatggaaacaggagaagcgttcaaaatgcgtgtgtgtcgtggttttgcggaggcgaatacctgtctccttggccaagtctgaagtgctctccacctccctctcttggaacatgacttctgatacgactattccccctcacatctccatgccacatcaaggactgcgcaacttgtgaggcccttcacatactgtatacataagagagcgagtggcgtccttcgtggaagcgggaggagatttgcgagcgggtgtacgcctattactgagacaagcaccgcgaggatg

SEQ ID NO: 6916 - DNA, 700 bp, Nannochloropsis_gaditana
ggctattccggacggattgcaggcaagtgcacctacagtgctcggcacgctacaactgttgccgcactttgttgtgtatgtgcgacaaatgaccaatttcctcaagcaggtgcacgattcagccaatagagggaaggaaaagtgcacgaaaaaaattcctttcccgacacccctctcctgtgtccaaaagcgttaagagagtcgaacgttgaagcggagtccgccgatgtatgcgcgaggtgctttttggaaaaatccggagtggccctgtgttcgggaactcacatcgaataagagaatccatatcaaagcacattctctgtttacactttattggacgaggcattttggactcggaggggagtggcggtggggacagagagctcgaaaccgtttggtttgaatacgccgtttccgcggcgcctgaggatttaaaaagctctgtgactcaggctcaacgtcttctcacccagcacacgtcccgaacccacttgcaagaacaggtattggagcgggcaacaaatggaaagacaagaaacttcaagtgaaggccagtcgctgtacaaaaagattggtgctttctgcgcaggagctcagagacaagatgttcccagggagtgagagataatgaaccgtgtttccctcttcttcagtgagaatttttagccccacacactatgctactcctgcacaagctatg

SEQ ID NO: 6917 - DNA, 700 bp, Nannochloropsis_gaditana
cagaggatgaaagaaatacgtccaaatggtgcttaggatcgggaggaagtggggataagtggtcatgatggtaggggatgtcaaaccaggcatagatgcctgaaagagacgggtcggaaggaccccccggagtgctgtgagggcggtggagctggctgagggagggacggaaggacggcttaatagggagcgaccgtgaacgctgcattaaatagagtacctggattacatgaggggaaattgatgtctctaagaggacaaaagaaaagggaaaaagggatctcgcatgacgaataatgaggacaggactggctgaggtaggaaagacgagccatgcggggcgtactgagcaccaacgagggcaaagtagtgcattcatggaaaggttaacatacaaaattagtcacatccatgcacgccttgctccgagtctttaagcgtcccccatggcgaaaataatgaccaccccatctttcacggccctgggagccgcgtcccctcccctccatgctcatcttcagcccggtctgacattggctaccctccctttttcctttgcgcttcgcatccggggacggcctggcaaatacaatggacgcgtgctggcaacatttgtgtgacatgcgcaggatgctgcggcagaaatccaactccataggaggggcgagagagaagtcaagagcacgcgcgggaggggatg

SEQ ID NO: 6918 - DNA, 700 bp, Nannochloropsis_gaditana
caaggcccaaattaggccgaatgctaagcgtgcgatcttggcaggcaagggccaggccatgattaccgtcaggctcaaaagcaaagatcccgtcgacaacctggagttccaaatgaacctgccaaatggcttattggtagagcgaacagcgatgcgtccgtcctcaaagctctatacgccaccgcaaattgttgagaatatcgacggaacgacggctattttttggcgtggcctcgctttcaccaaacgcaagggagggaagcgccgctttcgcgtgaaggtgaaggctgacgagtgcgcccctgaaacgttgacagtagatgctttcgcttacctagtgaatactacaggggcctcgtgcatcacgacgctggccgactctacaatcgtagaagtacgacacttgaaaaaaaaatatgtcgcgtcttgcgcgccgactccagctccttctatcaatcccacgcagccgtttatgctctttcgtgaaggacagcgatgctcgcaagcggggcgcctggccccctttcaggaccgtcgcctgtcactatcctcggaaatgaagagacatggcggcttcgccgctcagaatcattccggagaccgagatctccaatcaattgataccccggaggcttgctacgaatactgctccctgaacgggggggaggaaacgccattcttcgtcgactggaataccatg

SEQ ID NO: 6919 - DNA, 49 bp, Nannochloropsis_gaditana
agtgcccccggccgtctgcacccccgtgccatacacgacggccaagccc

SEQ ID NO: 6920 - DNA, 700 bp, Nannochloropsis_gaditana
gaactagaagagaagttgagggaatgggaggcattaatggaaaagaatccgtccggaaatccggagcagattgagggagatgacaacattcttttgtcatgcaagacaaaatacatcattttatttgccaattgttgttaaaagcattaagtacgactgatgaacatgagatgtgtcgcgtgacagattatggcttggtaatcgcaaagatttagcaacatgcgatgctgcggtcgaattggcagccaataccaatttatgaccacacgtttctcagccttcaacaccaagaaatgcctccttaaaggagaggacccagatcttgtcatggcagatcttgtcatggcaattggccttatggttctgtcagatagaggaacaaatagactatagcctttgtgtatatgcactttatacgaagtttttcgtataaccaccatttgcgaattgctaggagcttttatgaaaaatttctcaagtagacgatgcctttatcagatttctttagcgatgcgacattgagcggatcggaacggatcggaacgccctcttgtcctaaactgtgagcaaaaatacctggcaaaatcccgcagcgaaaaggtcgcatttttctcacagacgcatccttttccccagatctccaacgattcagggaacgtttgggctaaatctggtgtaggtcatggcgttggcgcattcg

SEQ ID NO: 6921 - DNA, 700 bp, Nannochloropsis_gaditana
gggtagagtatgtaaagttggaatgaggacatggaatcgaaggggaagtgagggatggaggatgacacaccagtaatttgacgagcttgaaaaataaatcactcgtacgttagcgttcaaagttatatgcctcgtccattagtattcttggttattgtagtcgtggtggagtacaacgtggtgtgctgtctaactcccaacatcattccttatcgcggcaaaagaaagaagaagaacgggtgaaggatgagctctctgggcagagcggatgcgagaaatgaggactcatttgattatctgcctaagaaattgcgtatctatgtccacatttgtttgtaaggtagagcaaacaaggcaacacaattttcagaaacgccgggggcgagggtcactggagagaggaggttatcacgcactgcgaatgtcccacatgctggtcaagacgtccgcgacgaccactgtgaaagctgcaaggaagtgaggagtagttgccgccttttcaaaacggagaaatcggtcgttcgtctttgctgcccgacaaggttcgggggcgtggtggttttaggaacacacgcatgtccctgggggttgaagacttgaaagtcgctggaaaacttccacttgccgtcttgttatgctgtttgtccggcaatttcaccacttcgacagcccgacaggtacatccacacggaacgatatg

SEQ ID NO: 6922 - DNA, 700 bp, Nannochloropsis_gaditana
acgcgctccatttcccaattacacaaatcaagggatgccaagcaaaaaaaagaagaacgaagccacgcgcttgcctttgcttttctcttgataaaccccctccctttcagaagacgggcatcgaaaaacgcccggctccccaagtttttaaaaattgcgcgaagcctgcggttacaaatttaaaattttggcgcgaacgacacccaccttgacctcaaatccttgttcgccggcttctgccgcctttgtcttgggcacactatcgacgggagcgcggccagtacggaaggccgccggactaagaatcgttgttaatggtagcaggggtctcggtcagggaaatttcagcttttggcgtctcgttgattgttgagtgccgagtgatgcccctaacttacttcttgttccaagatcatgtccgaacgcgattgccggctgcccccctttagcagccttttttattacctgcttttcgtgcacatacactgtttgttgtcctcctctcgagtagaaatcatttattggttgattacccctcttcggactacgatgagacaagttcccgtgatgtttgggataacagttgcccacttaatcctcccaatccaacctcgagcaggaagtcctcagcggatcaaaattcaacttaatactgaaaggatccttccacactcccacagttcaccaaataagtaatatg

SEQ ID NO: 6923 - DNA, 700 bp, Nannochloropsis_gaditana
ttcacaagacaaattttgattttttttcttgttctgaaaaggaatactttgttggttgtacacatatttggagaatgttcgtattcttacatggatatgcactgtgttttggagcagcatgcaatctcgcgtctttttgggggccctcgctccagtcccccttccgtctgggccttcgcccgatgacgctggccgccggcgagagaggtcagacaaacaagcaggatccagacatttgaccacagtagcccgccccatcgggaaagtgtgtgtatcagctcattgaagactcacacgccgtgcatttcgcaagcgcactcattgagttgagacacaatcgttgaggtctccctcggtgcaactagcaagaagccgagacgggccagattctcacctgtgcgacatgatgtcgggtgcgcaccgtggccacagaagtctcacgccatcgttatctccttcttccctgttgtattctgatgcctacctctggcgtggacgtcggtggagagagggaaggaggtgtaagcgtcaaccccgtcctcaactcccttcagcccctttatccgagtcgctcatgcctttctcttttcttttcacgctaatgcacacggtcgtgtggcatccatcactagcagtagctgccacacaagtcttagtgcgaggagtagccgcagcagctgcagcagggtggttggtcatg

SEQ ID NO: 6924 - DNA, 700 bp, Nannochloropsis_gaditana
gctagtgcggccagcgccaccatgagcagaaccaccagaggcgacgacgcccgcatcctttcgcagatctcgtggattcccgctccagattatgtaagaaagacggagggagagattttcagggtttgccttgagccagtcctaaaaagtagtccactgttgcccggtcaagtggcaggatctggccagggggagatgggagggggaaggaatcagtggcaggtctctgaaaaagtaattccacaggtgcacgggggccgatgaagccttcgctccttttcgcatacatgcaaaaagtcaccacatcagcaacgggatggtctgagtgcttcatcagggcggactgacgccacgccgaccacaaagcaggcaatcgatctctctcgctaaagcgacgcatgcacgtacggagacggtggcggggtccgcgggaaagaagtaggccgtgaaacgccagcgttctggggttctgacctggacaaaccacgcgcttgttgtcctccctgaaatattttcctgcgtcgttgcgttatttttcgtaaactcctctctttgtgactaacggtcaaatctccgcccccgctcaatgagtgatcctggcatcgatccatccatctctaatgcgcaccgaccccgaacaaactaattaagccagagagattcgtccgtccaccgtagcgtgccaatcaccagactggcg

SEQ ID NO: 6925 - DNA, 700 bp, Nannochloropsis_gaditana
gcctgtcacgggacccttgaacaatgcgtccacataccggtgctaggcccgtgatgaccccgtccaggattgtgggtgctgtctctgacgcctgtgaccataatgggaaaatacgacgccacacatacgtaaaattagtgaaagtcccgagccgccctctgccaaccgtaagtacctgctcgaagcgaatgaccccctggatggacgtttctgtgtcaccaggagcaccgcggatgagtgccacgcatctggccatcgttaaaccttgacgtaaatttagcaccacgcgattaaataagtgagaggctttgtgagcaagaaagtacgggtttagaacagggcagaggggaggaaggggggaggtcgagagggtcccggagggcttacgacagtcagagtccagatttgaacacaatttatgcctgcgccgcacgacctcgtcgacgcgcatggcgagggctaatgaggcattgatatagtacgcatgaagcgtcattgacaagtgacacagctggatgataatcgttgcctccgcacagaccttcacacaatgaagcgaagcagagaagcgaggctgtcgatgcaagtagcacggtcaaaggaatatacgacccagatttttacctccgcacaacgctcaattgcaatcctgcacctaacagtccacccggccaaagcttttcagttggtcgtttctatg

SEQ ID NO: 6926 - DNA, 700 bp, Nannochloropsis_gaditana
aatttcacagattccttttgattgttttactccaaattcatggcccctcctcccatagcaacggggcagaaaggaggaaactttcgagtgaggcaggtttactttttctttccttttgtttccttctctttcggaaatggcttccttttgtatcagcccataatgtccgctatgggttgcgcatggattttactagttacataatgtcaaagtgcaagtgactgaaagtgatttgatcgaaaagctagctgctcaagacgcatccaaagaaaaagaaaaatatcttcgaaatgaaactttcccgtctatcattacactaaaccaaatatttgtgagacacattttcgtcttttttgttatctctatttgtaccgacgcgcacaaaagagcgaggtgctgtccgttgacgcggtcgctatcgccttcgtaaaaccatgcaccacctttttttccatcactcaggcatttttggtttttattgtatatcacacaagtgcttgctccaaagcgcaggtttgggataaattcctgctgacgcaacgcgcggactaaagccatcgcatcggcagatacccgggcacggaccttggtcagggttgcgttggccgaatggcaaggcaaaatatgcatcgataaagctacaagaatggtacaatgggtttccggcttgcgaaaaatgatttaattcatagccaccatg

SEQ ID NO: 6927 - DNA, 700 bp, Nannochloropsis_gaditana
caatgctcggagccgtgcctctcgcatcgcctgctgatccatgatgccaccctacacaaagaaaaagcaggaggtacctaggaagaaggaggtttgaagtattagtaggggaaaactttatgttgacgtcggtaatgatgaattcccaccgatccatttctagaaaccgcccatcttccacatatagtgtttagatctttgcgttacttcctctttgagccgacctcgacgtgaaaaccagaaccagggggcgggacgaacaagtgcgcccgccttggcgcaggcagttgacagtggagaagactgtagctgtcctcgatggggtgatcacaccccgcaaatgaccagcaaaagcattgtatgtgcaccaaaattaaccctcgtcacggtagcatgtcccggtggcgttgcgcgttcattatcaatggcagggtagagagcagacggggattgcggaactgaccgacacgccccccacttgactaccatgtaggagtccttctattcctgaggcacagacaaataacacacactactaccaccacccacagccggtacaagtatagctacatccttttcaacggcttttgcattggctcgagagataatctcgctttcaactggattaagcacatatttttgcagacgaccttgaagccgcaggaggttatagtctggcccggcctctatcactcttatg

SEQ ID NO: 6928 - DNA, 700 bp, Nannochloropsis_gaditana
cgaggcaaccttgtggaaggtaggcttgtatcatcgtcgacctgatgcgagatcgtgtccatgctgctgtggtcggtactcttgacaaaggcgccgtaggattgcgcttcctgtgtggctccattgtgggaagtcccgaaccatgccgcccgccctccggccagcgggctgggccctccgcggcgaggagaaaggaccaggggcgcctcttcctcgtctctgggttgcatgacacaatctcgcggctttgacacctgtggacgtcatggtaaagcttgagtcgaagggctagggactcccaggacgatattcatcaagaaaagttgtcattcgcactctctcgttcttggtcgtacagggcgattcgcgctacaagggagttctgatatggccatgtcccacaccaaagcttcatgcatgcagaaaaatagcgagggtggaactattttgaaaattttgggaaggtctgaagttgacggggcgcggttgctgggtgtgaactccaaaagtgaatcacgcgcgcgctcaagcagctacattatcacagcgactcgctcgacatgtacagtacaccacgacaccaggaaaccttcacgctccctttccctccgcgcctttctcattcggggtctcatcctgctaatttgttatattttcaggtgcaaacagtcccactggccaccggtaaaggccatctatg

SEQ ID NO: 6929 - DNA, 700 bp, Nannochloropsis_gaditana
cggcttaaagcctcttcctccgccctccgagcacaggaaccgttgcttgcgcccaggatacattcaaccatatctcggttttcctgtcgaaacgtgccctctgcacctttcttatccctttcgccctcctttacgtatccacaaagtacacgtgagatctggacggatcagcaatgacaacgcctttttttaacatacacatctcatgacgaaattcgaccgaatttctttgtgcgatcatggcttcgcttgtctcctgatccaaacgaggacctgtgatattttgctcccgcatgaatccatgtctttaatcactgcacgcggtgataccgcctagacccgtcagtcgcataagcatgtaaatatatcaatgtataactgtatgttgcacttcagctgcgagtctgcatggaagctgcgaggatagacaatgcatagttggagggtgcgacctcaagaagcaaactcaacgcgtaccctctcatgtactatgatctttctgtcaagcctcttggataaagtagagtatgggaagcaatttatggagtcttgcaaagtggtgtaggcactgaaacggtttactcggggacttcctcccctgatcttctcgtggtacttgtactcttccccttgtcttcccttctcactgaaattcatatcgtccatcacattcttccatagtacaccccctcctacaatg

SEQ ID NO: 6930 - DNA, 700 bp, Nannochloropsis_gaditana
gaaactgtgcgagatagagggagacagagatgtacgggtttcttaggtgggaccataatgcgtgctgaaatgcggagcaggttcactccagggttgtggacggccacattgtatgacatgcagggggctgctgaaggacagacatttttcattggaaccttttgaccgcccgggttgttacctgataatgggcgtgctgctcatggccaggcgctgtctgtcatctctttccttttttattattaaatgtcacgtttccattttaacaatgtaccggacataggtattagtgtaaaaaattatgacactctgcaagccttttccttcagagtccaattagcgcctttttttgggttccagcctcccgccttcccagcctacccggaagtctcgaggaggcctggagagaaaggagaagctccgaacgccacgaatacgctttttgaatccccgcctcgcctcctctgcctcaataactcccgatttccgtctttgcaccgttttttcacaaacgttgaagaattcagattaatgcacaattgaaatggtgtcaggcatgttcgtcgcgggcccgtcttatcgcgtgcgctcgcccgaagactttagcgagttccaccttctagattccccctctcataattgctgattactgatgatgaccgatttaccagacactgtcacgatttcttacagggccatg

SEQ ID NO: 6931 - DNA, 700 bp, Nannochloropsis_gaditana
tgagtgtacgcgggagggctcatgtcgggggcgatgtctcggcccccctggcattgagaacgtggtctcagtggatgactgggagctgttgtctgcctttttactgccccgtcgaatgcgcgtcgcctgcagctaccgtgacacagccctcaacgcgtgccagactgcaactctcacccgttcgccctgattcttccccacccaggacctcgcctccgcggaggcccttgcggccgccctcggccagcacctggcggaggacgagttgtaccgtgtggaccactacatgggaaagggcgtggtgcaggctatcctccccttccgccgcgccaaccgcgggtggctggaggctttgtggaccgggcggcacgtgggcgcggtggaggtgtccatgaaggagacggaggactgccagggtcgcacctccttctacgagggctacggcgtcatccgcgacgtgctgcagaaccacctgacgcaggtactggtcttgctgaagatggacatccccccggacaaggagagcacgtcctccccctccctgggctctcaccaccaccgcactgccgttttgcgcgagctggtgctggggggcgagaccgagggcggggagtcccgagcctccatccatgtgggccagtaccaaggctacctggaccacgtcgcgtccgaccgacgttccgagccccgggtggtgagg

SEQ ID NO: 6932 - DNA, 700 bp, Nannochloropsis_gaditana
agctttgaatgcatatgtaagagtggaggtcggcaattgtattgactaacgttttcagtgacagggtgtaatgtacgcagcagcgcagtcagacatccgttcgctcccagacactattcgctgagacgggaaagcgagtggagaacagacttgccgcaccctgcccaaacgacgtcccgctcttcagcaaggagtcttccggcagtcaagtgctagggagggcctgtctacgtacggcctgtcaacgtggatggtggcatggctgcgccggaggaatctggatacttttcttgcactggttgcccccgacctagtgggtcgttttgtacgcaccctcacatcccccctctcgcatgtcttgcccatacaacgccaagcaagtgctcatgggatggactttagacatcatttgtatggcttcctccccgaacctgctggatgtcttcgattccaccttcaaactggcactgatcttcgtttaatgacgttctcttggtatgctgctcacttggttacgcatctgtctttactcacattccatagattaacgcgattcgccaccgcacgcacagattaaacaatgagaacaacgaatctgtggctcccaaacacgctctccgtctgttcgcgcttcgtatcctctcttgtagtttttctcctctgcctctctgcttctccgctcaatgccgaggaggagatg

SEQ ID NO: 6933 - DNA, 700 bp, Nannochloropsis_gaditana
ataggccggtttacaatcacgcgacgtgcttcaagtccctcgttagtgacgaggcgggcgcttgcactgctcaataaggacaaggccgtgcttgtctcccgtagattccttttattatcacgacaaacacatagaatggacacttcacagcacaggacgcctttgggcatggaggcggccgataaaaatgcaccgtcctcctaagtcgatgcgcccacccgctgcattcctcctccccgtcctcctccacgcctgtttgaacattccccatgtcactgccgatgacattatcacgatccgggttccgaccatgggtttggaaatacaagggctttcaagcaaatgcggttctgatcaattttggggcattccatacgcccaaaggcccgtcgagcgctggaagcgggggcaaccctcgtgggcggagccctccacgatgcctgaaggcttcgcacaatttgacgcaagcgggcacatgccgcaggagcgctgccctcagctatgcgatggcgttgtagtgggctcggaggactgtctcctgctgaacgtctttcggcctgcctctccggggagcccgatgcccgtgatggtctttatccacggcggctcctttactgaaggaggcatcgactcccctctcttagatggcagctccctcgcggcggaagagggcatcgtgattgtcactatcaattaccga

SEQ ID NO: 6934 - DNA, 700 bp, Nannochloropsis_gaditana
agcgtatctaacgacaatcttcccttgtgagggctcgtctccccgtcctcgaccatggtacacctccttcgagtgttcaagaaagaagaagtgaaggcggagggtgaggaggttacgacgctaaatcaacccaacatccaacgagaaagtcaaaattttcaagcgtactatgtatatttctcgaatcacaggtctataaaaaagtccaacagtcacgtcttggtcaagtcctaacgtaaacatccgcactttcaaggtcggtgtatccgcagcccgtgaaccgatgacaaagtgttgtacccaatcacgcgtccttctacctctactggcactaattttcttgttgtaggccccggctatgccttcgccacgcggcacttgccgttggcctggtaataatagaggtttcctagggggtggggaggtagagtcgaagcgagcaatcagcgactcatatccatccaagcctcttcccgccttcgtgtgcatccctgcccttctcctggtgctaagtaccatcgcccacctcctcccgcacctgtctctcaggttttcacccctgcttggtacgggggcacgggtccaggctgctctatttcacggcgaacgcagtctgagagctgagtgacgaagactgactccggccagttgcgatcatcgagggcaaagtatctatttgcctcgttacccgcgtactatg

SEQ ID NO: 6935 - DNA, 700 bp, Nannochloropsis_gaditana
aaaaggggttttacatgctcggattaatgcagcttccgacagggcacgtctacagcccccgcggatagttatttttaagattttaattgccgagttgcaaaatcagtagtctttgaggaagagtcatatattgatttatgtagcgttttcgtacatttgtgagaaaagagaaggcataattaagcttacataagtccctcctcggggggtagcgcaagcccgcggcccatccgcttaacctttgcccctctccatgttacactctcttgcatataaatccagagccacacgtttgaattcaccgtcccccgctcgctttttcagaaaatttctggtagctcactccatgttgcgacgggtgcaatggattattcctggccacaaacgacgcctcaagagagctctgataggcacgccctcgtcatgccgacctccccactccggaagacctgttgctgccacaattatcaatatactcgcacgcagacggaatgaatgtatactttttcgagattccctctacttaagcacagcaacaggcacagcagcatcaacaacaccagcgcatgcatcgacaacatcaacaggatggtcaagaggcaaggggcggcgtcagacgtatgtctccgaaccacaaatatcagatccctacgccgatttcggcgctcctcacaattggtatgtacaggccaggaaatta

SEQ ID NO: 6936 - DNA, 700 bp, Nannochloropsis_gaditana
cgagcaaacgagctcaatcaccgattttgggacaaaggtgcctgataatggcacccggggtatgcaagcaaattaagagagagctttcacagccaccgtccgttgatggaatcgctcgagagcactccggcgagagttgctccgttgtcagaggggacaccagtactagtcctgtatatgtaacatgcatgtcccatctcgaccatgatgtgcacattctgtactcctcgctccgagtgcgaggaggcggcgtgaaaagacctggaaaggaaggcaatgtcggggtagtaccagtaggggaaggaatagccccagccggagcacagaggcgggaaaggaaagaaaaggggagggggcttgatatacaaatggctgaaggaaaaaggcgtcattatgagggtgcagtatatgtgctatatttgtactcggaatcaactttttgggggcggatattctttctcctcccatccacgtagttaggaggcatttcccccccgtctgtcctgacttgcaaagcgagcttggagccccgatcgtacagcaaagtttctcgatctgcatgtgggaatatcgaccatttgtggacgatttttaacgcgaaatctgccttcctcgattggtctgcaccgctcaacgacatacttactttctctttcacctaaggattaaggattcccgccgcccattaaagctgaagatg

SEQ ID NO: 6937 - DNA, 700 bp, Nannochloropsis_gaditana; identical to SEQ ID NO: 5018

SEQ ID NO: 6938 - DNA, 700 bp, Nannochloropsis_gaditana; identical to SEQ ID NO: 5019

SEQ ID NO: 6939 - DNA, 700 bp, Nannochloropsis_gaditana; identical to SEQ ID NO: 5015

SEQ ID NO: 6940 - DNA, 700 bp, Nannochloropsis_gaditana
  misc_feature (161)..(448): n is a, c, g, or t
gggcggggcagaggttgctgagtgcaacaatggaggcggggtggggaccaggcattggtaagggccgggcacggctagcgcggtttgagctagaggtggaggggaggcggtccgaaaatcttgatgacgagaaaagacagaccatggtagtggagtgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagacgcaggtagggctcgagaaccgccttgagcgccgccaggatctccatccactagggtgggggagggatgttcgtggggagatcggaggctgcaggaggaagaaggagagagaggcggggacctcggtcgggcttgtcgtccctgtcccgggaacgtgaccatccaccagccgcagccaaaaggcctccacttctcccgccccccgcaaagctggtccagggcttgaacgagacgcggtgtaaagactt

SEQ ID NO: 6941 - DNA, 700 bp, Nannochloropsis_gaditana
ttgtgtttttgggaaggtcatcaggaagtccttgatactctcgttcgcaaggagagggacttgacctttcgactcggggcttttatgcgctagagcagcggctcgagaactaggaggaacaaggcgggaagactgcttaacattgcccagattgttgttgagtgctgtcgcccgcttaacagtggcaccgtgtccttgcaccatcgtgcgtgcaggtggactaggtcctgtttcatgttgcaaggttggtgttaacaagtattgaggcgtccaagttcctggcagtgggcccccaaggtggcggcaatcaagcggcgagttctcgcactacggtgacgaaaaagcgactcggcgaggcaggcgtagcaatgcacaatgttgccgggtaattgtgcgtgcacgaagccctctgctgaaatggtgcatttaaagaggtaatgtagagggggaaatcctcatcgtcactctccctgcgcgtctccggcattcacatgacaggagggaggggacgagtgcaagacttattcgatcctcggtcaggagggtccctggggcaagcacgagtttaattgcgtcataataagctccctacttgtaagccatgaagcttggtaatcttttgcccccaacggatgcatactgggccaccattttttttcccgccttgcttggatatcttgtgctgcttcaggctgctatg

SEQ ID NO: 6942 - DNA, 700 bp, Nannochloropsis_gaditana
gggagaaattctgacgacagctgaagacatgacagatcgacagaataactttaatttattctcctacaacgagattaacgaccgagtcgaagaaaccagcccctcaacatggatactggaagaagagatgacgactgattgcccaagtgcatacattctgatgtataaaacaatcctgatcggatcgcaagggccagtcatgagagcgagaggagccgagtcacactcaaggcaatcttgcaaagtatacctgataataagaatccctcttaagatatataagatcatttgcttatttttgaatgctatcattatatccgtattaatcaactcaatgatgtcgaaccacatcagaggccaaacattatttggtgaccctgccaacctgttacaagtgccgctttcgatattggctacccggaggtacgtgacgacatgcactcgatggaaacgtatgtgtaagtgcgtgccacatcaaagcgcgtggatggagagtagataatataaatcgaagttttatgttaagagcgcccactttacatgtggatgtctaacgcatgaacggaaagaagagagaactcagccctagacacgttttatcgcgccctcaggtcctcagctaggagagcgcttgttcatccgccttcttttctcgtcgttcacgtaagaagagagacctatacccgtcgcttcgagcatg

SEQ ID NO: 6943 - DNA, 700 bp, Nannochloropsis_gaditana
aaaagcttcaaggtcgtcgctgcctcatgaagggccctctgccgtgatctctccgccgcctggggcacaacaaaggcccggaaactggttccaagaaggcagatgttgtaggcatagtcatgtctgtgtgcgtggtatcgtggtcggagaggatgacggtgggtggctggcgtcgtgtactcgtgtggatatcaagcgagactcaatcatgatcatgatgccaaaattttgccgaccctctgttctcgtaaagtaaaagcgagcattacctctcccttcggttgcacttggacacagcatgttcgctggcgtccggtcttgtcagaacgtggactttcttaccacaacgcactacgtgcatggtcttttttgtagcgcgcatgccatgggttggtgtttgggggatgggaggtggtcgtgaggctttgggtgcgcgcgctcacattcttcgaccagatcgcgaagcaatttctgccgtgccagtgtactgacaaaccagctgatcttacgctttgcaatttccctttttttgttccatacggtacgctctcagctcctgggaaagtcaggagctcggtagaatttattgcctaggatctttcgcaaggcccgaccatatccaagatcgaagagctgttaatatcagagctgcgcctggaggagaccgacgggcacgtcaaattgtcctggccaagtaatg

SEQ ID NO: 6944 - DNA, 700 bp, Nannochloropsis_gaditana
tcgtcagtttaatttttccaataccttgatgtatctacaataaagacgccaaactggcaggcgctggaaccagggccaggctcgcgagccatctctgtaactcgtgtctaggtaggtcatcacgtacgccatgaagcaggctcgatggagcgcactggcccacgaggtagtagatgggacaagcagaaaagtggcaatgaaggccaggaagcttgcatagcgccaaaattgtttgttgggtttctgggatggcttgcatttgaaggacatgtcggggccgtgagagcgatgcggagaggtcaccagaccctgcgtcttcctgtagtcgcgtacgagggaacgtaagggacagaccatctcacctctgtatgaatgctgtaatcttcccaatctctggcatgacttgttcgggcgagggctggcttgtttgtttcgaggtcccatgctccaaggtcgacgccctcgcctgacggcttgaaattcgcgaggttcccccttatggggcgagacgagcgtgtctttcgcacggagacccattttggaacacaaatttcgactcctgccactgcattggaaaacgttatcttgcttatctgaactgccgtggtgtacctttgactctttcgtggcgtttcgcccttttaccctccatcctcaggaagtcaagatactcccccttcatcacaagcactcccacatg

SEQ ID NO: 6945 - DNA, 700 bp, Nannochloropsis_gaditana
gtcatgctcgacgaaaaggcctgcaaattttccaaggacaacatattttctttccgaaacgtagggagtaaggtacaaccagaacatccctctacctagattgcaatgatgtccctcatcataatcatagaaaggtacatattccaatgaagaggacaagaatatcgcagccgaatccacgcccataccgacagcgcacggagacatagaggagacagacaccagtccttatatgcatgcatgagacaggctatcgctggaaagatcggggtccgggctcggacgtggtcacaccccgatcagccctcccgtgcagatgtacagtaagcacacgtgctgcctttaggggggaaagttcatctgtattgcagttgtcgtgattaccctctattctagaaccattccccttaaaatttatcgcacccgcgaggtcccgcctcaagagaaatgtcatcttcctgccgcttccttgataacgtggggactgatgcagagggcctgaaaatcaattatgagtgaaaagaatgcactcaggcatgcttgtcctgtgaatacgattttgactctcatcttatttgaccatgaataatctattacattgtgttgaagttcgcctggtacggagatctcacgaggttcggcagcttaatctccatgataccatccatcacaattttaaacttaccataggggtgccatg

SEQ ID NO: 6946 - DNA, 700 bp, Nannochloropsis_gaditana
aagagcggtcgtaagcgcctctctctccttcacttcctccctctctgcttgccctcaagaaaagggcacttaccacaaagggtagcggccgggcggaccgtacgctttaaagccaccagagacatactcgctgtgaagagatgtcgcgtacgctgttcgaagacgtgtgcgcgggacgcgagaggaacgcgaatgagtataagagtcctaggggattcatgtgtccccgtttgggaagtcaccccctaaaaatcattgcagggccgccccactcgtcctaaatgccgctatgcaccatggacacaaatcacaaacacgacagacagcctcaacttcatccaccacgcgtgcggacgccgggggctgtgcgtctctgtttgcgtcgtgtgccgcatcctaccgtccgctttttccacgcaaagtcctctccctccgccgcataagccaatttgcccttaggtcgtggcccccccttggctttgctgtcatttccggtcatgtgacccgtccaatgtgatcgaaaacaacagcatgatgacaaggtacaggatgttgacggcgtcgattgcggcttctcgtaccggcggtgttgagaaacttttttgtccgtcatcggagagcgtgactcacccggcttggaccccgctgtttcctttcccccctacataaggtcttaggcacaggtaacagcgtcacaatg

SEQ ID NO: 6947 - DNA, 700 bp, Nannochloropsis_gaditana
cgacgcctggaccaaggttcggacggcagccaggcccgcgaacgacgctcccaccacaacaatcgagacggggggcacgttctccggtggcatcgaaggccgctgaaagaaggatgagaatgctcctcccatggccttgaccaccttctcgcacgtaggcctgtatatggttgtgtgattttaacattatgtgagcgcctttgttggatagggagtgagctatcgcacgactttcgatcgagtgctaatatattttcagattgctacgatcgatccaagtacataatcttctctgaaaacacgcaaatgctacgcgattgcctggaatttagaccgggctgtgacgtgaacgttttgttctcatatcattgcccaagctggtgcacaccagcatcggaacaaagggacaatttcgtccgtagtgtgtggtatcgtcgctcaatcttcaagtcatgcgaccttcataaaatggtcgtgcgtttatgaaatatttcatgtctccagctatgatgctcctgacactttcgtttctactgctacaggcttcttcccgctcctcatagtccggggacgcaatttcatgcgccacgtaagtttgtccgtttttctagtccactacgtcattgcaagtatttccgcttcgtgggccgggcaaatagctgaaaaggcaggggaattcctagaaaactccttacaaatg

SEQ ID NO: 6948 - DNA, 700 bp, Nannochloropsis_gaditana
ctcttctccgtgctcatctccactattcgctgggcttacattatcctcctcgtaccagccgtagcccccgaccgaatggaacatcccatccggtgtggtgccatgcataggtcctccctctatgtccttgccgcctactggagatggtgccgtggacaaagcagggagggagagcacatggctctttgcgtctgcagtcaaccgcacgtgcgaaagtgttgattttactttttcctttggttcattgtgttgtctgggttctcccagtggcggatggggggatggtgtgcgagaagacgaggacattccggccaccttgcactcggaatggtcgcctgcgccctcagcctccgcgcccgacaagactgcaccgcgtgccctccttccaccctttatgataatgtttgggatacattacggcgcaaaatgaggtgaaagcacgagatacattgcttgcaagcggcggttgaaagccgggcacgggcagcgtcgtcatcgcgaacgcgtttgacgactcgtctcccggcgagacacagccaccccgcccacgctcgtttttggagccgaaatcattgaagttttccttttgatgagaaacaagcttttgtgccttagagcttgggtgcattggccaagaagcatgattaatgtcctgtattatacattgaagcagggacacggctggctcccttcggtgatg

SEQ ID NO: 6949 - DNA, 700 bp, Nannochloropsis_gaditana
tggcagtagtagcactaacagcgccagtagctcttacctgcgatggcgacgagcgacacaggacctgctgggattgggagggaatgccggtgctgcgaatacgatgggaggcgggactcgacattataaagtacaccactcccacaattctttccagccgccgccgcagccccgccatgcccgccacctgctcgctcctaggggccgggttcttcatccggggaaggtcgggtctcttcttttggccgcgcacccaacttcgggggaggccggcagcgctggctttgatggaggaatgctgggaggtagggatgaggagggtgggaagccgcaccataggactgggtccagtgcgctggacaggattagcatcaacatgacgctggaggcgaatctgcgggagggagtggggggccagctccggagggattgtcctgtggaattgatcgctccctgcgcggtcccatcggcctcgttagtcgagcacaacgtgctgcgggaagagggcttggtggtgccagcctccttcctagtcggcgacgtggtcgacttcattacccggatgagcaaactggaacggtacaatggcaggccgggagatggcagagaggcggaaggggggggcggaggcccctgtcggtctttggaacgtatattcgtgacggactgcggacggttggtgggctacgtgacctcgatg

SEQ ID NO: 6950 - DNA, 700 bp, Nannochloropsis_gaditana
aggacaggcgctgctgaatactcgaattttttcatcttacctgcctcttggctatttacgggtcctgggaggttataaggaccagcatgtgctgtctgttgaggagaagtcccatgcttgcagaccttgacaggtctcggtgcgagagaattactgcttcctgtactcactcgacgccgtgcacgtgctacactatcattccgtccgtcttgtttctcagcaaccttcgcctcgcccgagattccttcctcaagctctgcctcacccttagtaatggtctccaaagcctgtttcactttctttggtgaaaattttcggtctttccctgatttttggtcttcacacctacgtttcaattgcgtttttttgtgctcttctgcttcgtttccttcgctctttaccctttccacttgtcttgtcaacttcccctcaacttcgtctttcgaaagctcttctcctcgtgacgtcacattttctcctttaccgtcaattttcttgtctatctttatcctttccacatgtttccgaattttctcgttattctcgcttccccttttggtctgcttttgtcgccccctatctgcggggaaatgctcgagctccacacacttattggaaacttttgctttgatgccaccatttgtcttccgccctccttcgcttccatattcccatccggagggcagaatgagcagatttc

SEQ ID NO: 6951 - DNA, 700 bp, Nannochloropsis_gaditana
tgggctcaaacaatagaaactcaccatttgtaatattctgtgatgacgaggacgaagagctgctgctgctctcctccttctggtcgggcaaggcagtctggacgccgaaagggatccctatccccacgggcgtctctttcgtggtcaaactggtagatgacctgcgaaataattggctaaaccatcccttgtggccaactcgtgaagagaacgatttggctcttgccgcccgccgtggctctgccatgtcaagggtgctagccccttcgacccctcgaaatctttcgagcaagagtgcgacaaggagcgatccccccagcttctccgcgtccccgcacccaaactctgttaatgtacatgtattttaagtgaggacccaaccaagcccacttggtggtccgtggagcgcccacggcagtattgtcaccggccggtctgtcaccctccccccatcttcgctcctctctcgctggagtatcttcccatgcccctggccgcgcccccaaggcaactcacattcccgtcctccaacagacgcacggcactcgatgcaaaagagcgaaagcacgcgagacgtcgagaatccgaacaggaggtagcccgtcaggggactcttatttttggccatcccgcgccttccatcgtggtctgctgggactaccctcgccatcccacctttcccccagacgactgaagcatg

SEQ ID NO: 6952 - DNA, 700 bp, Nannochloropsis_gaditana
tgttcacaagactgctgaacggaaagaggaggcattgacggatgagatagtcgttcaggtgccaagagacgtccacacgcgcgaagagcggtctgtgaggggaagcggggcgcaaggagtggacggtggaaagggctggcaagcgagggggcgcaatgcatcagaacctctggggtcgagggctcatccccctttaaacacatgcgccacgcatcaagggacactcacgcacacacattcacatcaacagatgggttcttcgacctcgccggtgtccagggggtcagactcggagtatcaacagctgtgtggggttgaggaagagcgagaatgtgatgaacccccccatcccacctcgcgtttgctgcccgggcacgcagctcacgctgcagacgctccaaggaccccttgggaatgggttgaggaaagtgacagcgatcaagagtatcaaagtaccgacacagacgaaggactgctccatttcctgccgcccgcccccttgtttgcatggacagctgctcatcatccgaagtcgagtagcccggtgacccacgaaaaccaagagcagcgctaccgcaggtggctcgaactgtttccacgcgtggtaatgtttccaccgccagtcgtgaagtggcttccgaaatacaccagacatcagttttggggggatttgctgggcggtttgactgtagccgtaatg

SEQ ID NO: 6953 - DNA, 700 bp, Nannochloropsis_gaditana
cgcgctctggcggtcggaattcgtcttaggtctgggcacgaatgagatgcacgctgccgattcccgcaagatccacgtgactcacctgcggcactcccaacaaatcatagcaattttccttcccgcagaatatgttatggtagtccttcagagattgaagcccttggaagactgacactaggatcattgcgacgagaagatgagagcgcccgaacgcggcatggtaattgcgggccatcccctatgatttaacagaaaataattgccaggtgaggactgcaaaggtcgacagaactctcaaatctgagccaggccgctggcgacaagcagcttcaccgctgtttccaatgtgaaggcaaggatgtttgtgtgggtaagtgcctggtggaatgaggaagaaggacatcgaggggttggcgagtgctcaagcgaggaccgtccgctcctggcaaggcagacccccctgctcctggatccccgtggattccctcgtcttactgaccattttcgtgctctatttcgcggggggggattaccatatcctacctcttgcattatttacagggaaaatcgtccttttacggtggctgcagaaacattttggtcctcgttcgaacaagaaaaaggttgactacaggaggttgggaagcgcatctccgctattcatttgctagaaacttgaagcaaacctacttaaatg

SEQ ID NO: 6954 - DNA, 700 bp, Nannochloropsis_gaditana
cgccggtttcgctttggctcatctgagattcacagccttttgagcacaatagacaagattgggaaccatgaacatgagcgaatgaggagttaaaagttctgcatgtaaagaatattcacttctgttcggctgaaatccctagtgcttggttttgtcactgcggaggcacgctgggtccgactgcagggttcctcgtgcttctcctgttcttgttgctcaagtagatcctgagtggatccagcggcaacttgcacaatggcatggtgctatttaaagacatggttcttagtttataacccgttgataacaaacaacaccttctacttaggtataacgatgcgccagggctgcgaaaaagcccggccaacgtcggcagtatcaaaaaaggcctcggccagttttggcgaacctttcctccttttcttcacccctagctcccccacaaccacagctatcgatggaaagctgcccagacgactccaacaatggccacgacagggatgaggaagagacttcttgcgagtcgacctattttgtggagcgagatgaagtgctagctcggcttacgcttctagcagggccagagccccccgcctctcttacgggggagctcgaatggctacaaaaagtactggacaaatatttagagcaaagtactctcttagatcctgccatggaaaagatgttagccctaaccatg

SEQ ID NO: 6955 - DNA, 700 bp, Nannochloropsis_gaditana
ctcccgctcctcccagtgtgcatgttttttccgtgtcactcatccaacttggaccgaatcagcttctaattcccggtccatcgcattaaacgatagccgcttgtaatcaaagcgtatcctttcctcgcgttgcgagtgcgctcagctgcaaatgactctctgttgatttaagtccgtttcctatcgacaaagaataggagttttctccgagcatcggagaggaaattgccttcataccgggctccatatcatttcgtggatacatttctacatttttcctctctttaaagaagctcgatggcgccaaatcgtcgtggcgggcccttaactcgcagcagcagtgggaatactccgacaaaaaggactaaagcaacgcccaaagcgtccgagacatcctcagctgttcatgacaatgatttgtcggtcatttccaagaaagagattgaagaccgtggagcgggcacggacgaagacacagacacttatgttgacctgccgttcctgcgcggagagaagcgtgttttttttactgctgtcattttcctaacgcgtttaaacgtccctcgttgggcagaggccgaccatcaccccgcttatctaatgcggtcgatgatgcatttccccttcttagggctctgtgtaggaatttgggcggctgtctggctcgaggccgcggcggtgctctggaccccttttgtcg

SEQ ID NO: 6956 - DNA, 4 bp, Nannochloropsis_gaditana
gatt

SEQ ID NO: 6957 - DNA, 700 bp, Nannochloropsis_gaditana
tggaaagccattttttggtgaggcgccgcctgcttggcaggttcaatgcgcagtacgcatccaggtgcttgcgcatgagctcgtgccgtgagactagcaaaggtcaaagatcagacttattcgtatccggggaggccacggcttgtgcgtctggcgtgttgtcaggtaagatatctgcgcctacatcccgttgaaataatgggcagcgaaaagcgacaacctcgccaagaccatgtcgacgcggaagccatcgatgttcgaagggactgtctgcgggtactttgagaccgaaagcatgttttatgagttctttacaggtgttttccggtgacattggtagacggatacgatcttgatggctttgatttgatcggcttccgagcgttccatgtgttcgcacaaagaggacgcgcgcgtgcccacactcgggcttcctctgaccttacatgcagtccgcttgattattatttccaaacccaacaactccattgagtcgggcttgccatataatcctcattgctgcaccattccaccgttcctgtccatgcaactgaacttccctatctctcccaccaatttactttagatcgaagtggctgcgagaaacatcggtcggctacagctcgacatacacccaatcggatctatttcaggggagataggacgataacatttattcccatcctttcacaaaggaatg

SEQ ID NO: 6958 - DNA, 700 bp, Nannochloropsis_gaditana
gaaggtctcagtcctgaagcccgaatctcttcatcggcctatgtccaattattccagaatatgaaggcaagaagaaagagcagctatatgtaattgtcaaaacgcgttcctcaagccattgcattcgcttcgcttgacatgtcggtgcacagccggcacgttttcactttcacccgccttaccttgctcgcagacattgcggcgcaggctttgaatttgttggttgtctgatgcattgttcgtgaatccattcagacagcatctttgtcaaaagacacattttcattattctcaaatcgtcgtcgtcgcaatcaatgtaagctcaaaagtctgcaggaggcaagcaaaaggcaagagcccgaaagatcggaacgggtcagacacacaagtctttcttcacgattctaggccctgcgatccatcctaatcttattcactcttattcttatgcttgtgcatatagtttagtagctatataacggattctgaatccggagttgacaaaatgaaacttgaaaaggggggaaaatgacggccgccagatgagtatccaccgccacacgtacatcgcccgtctttaacgcagcagcatcaaaaatgtctaaagtcacttcttcttccaaattatgggacgtgcttacttgaaagacgtgggtggcttcctgttctctccctctttgtaaaggtccactggtccatg

SEQ ID NO: 6959 - DNA, 700 bp, Nannochloropsis_gaditana
ccattgaaccatccagcaatgactatgactactgttgtagcgagagaaagaagacctctggcctgaaataacacattgcaccgcgtctcgccgccataccctggtgtcaaatatttgctgtgaaggcaaaagcagatgcctcttggcgtccagcctccggcgttgttctgctttgtcagcccccctctaacccctccactcgatcccccaaaaatgtgccatttttgtatcccgggagaacgtggggccaattatccctcaatgcaacactactgcctccactgcggcgcttgagggggttccaggtgcacggatacgtctgttcatctagttgcttttgatccggggcgatgacgtggccgggcttgtgcttgcgctggatctatctcgtgtcgccataaacaaaacgtgattgccattgaccacaaagactagacaatcatggggtcctgtccactccctgaaatgacaagatctggccagatctagagaacctcaaggtcaattttgaattctcacccccaactcagataattgtttgtctttggcattgaatttaatcatggctgtaatcacttcacattatgcgacatacttttccgaaatggtcagtccgctgacatgctcttcgttttcgcaccaaattccacagtttgagggacagttcccttcgagaacaacggtctggacgaaaaagatg

SEQ ID NO: 6960 - DNA, 700 bp, Nannochloropsis_gaditana; identical to SEQ ID NO: 4706

SEQ ID NO: 6961 - DNA, 700 bp, Nannochloropsis_gaditana
aacggggacgaggtctcaagcggatgagatgagcaatagcaattttaacagcaagcctgaatccgttttcggtaaagcatacgagggtttaaagaggctcgttggtctaccgccgtccagttccctgcccaaattcgaccccaaagccatagtactgcccgagggcgccgtggcagtcccgtcttggcgggcgttggggaatgcttcgctcttggagggaaacgccctggccagcggccgcatcgtgtgctacgcgatgacaggcgaggacgtcctgcgcatggcgagcatggaatacggaagcccctgcgaggtgatcatcttgacagaagaccgtttcaccccctacagcatccctcgcaccatcaacgtctcccggcccctcctcctcctgggccggcccataaactccccggtgctgaattgcacgaacagaaacccccgcttgatcgacgtctacccaggcgcccgtttggagacgcgctccatcacgctggtgcgtggttttggctggcaggcggggccggacaaggagatcaacatggcggtggggaccttggtccgggtgcaagtgggcgccttctacacggcggtgggctgcctgtaccgagagcggaataacacgcgggcctcgttcgagagggaggtccgtcaagtgatagaccagccaaacactcgaactcggactttcgggcaaatg

SEQ ID NO: 6962 - DNA, 700 bp, Nannochloropsis_gaditana
cggcatcaagcaccggagtacatgtacgagaccgttcacattcacgtcatatgttgtacgtgatggtataaggagaacttctgtacctcgcgtgtatgcatgatcttgcttattgacttgacaatagatatttcctccctgagccaatatctcgtctggatccgctatgttcttcgcttttccaagcgcccaatcctcgtcgagccctcctattccgtaggagatcgatgcgtttttgaacattttttttcccgccagggccacatccatgtagatgtacccatctattggatcccgcgtcaatatggccccgaaaatgtagaagatgtggttcgatgtccatgcaggcatcctcattggagatttcaacttgaaatccaaagacgtcgtagtttggcgggtactccaggcactatctctgtttgactctatgtatttctccgaactgttagcatttgtcgttggaagtgggaacctaggatctagtgttttcgtcgtaagattttctgcgattttattgcatggcctatggctcgtttgtagtgtatttcccaagctattgggtatgcttccacccaaaatagcaacattttcctcagttggataggccctggtctcacgaaacctgttctcgagggattccttcaccctttccatggattttgcactcattgatatttttgaagcagacgtttgaatg

SEQ ID NO: 6963 - DNA, 5 bp, Nannochloropsis_gaditana
ttgcc

SEQ ID NO: 6964 - DNA, 700 bp, Nannochloropsis_gaditana
ttgttcatttccctatgttctgccaaaagacgaataacgtacttgcatttagactgacacaacctctgtatctcgggactagctcccttgtcgcgccgcagaaagtgatcttcattagtttttgtagagacgtccatgcccgatcattcgcggcggtagtaaaataaaaatgattgcagcgaagaagtccacatgtcccctttctgtcttttcctactgtcaatgtcataataagttcttgagtggtcgcacaaatgcaagtattgttgtcataatcatgagaaaggaaacccaaagcagtctgacgaaggtgaaaaggttgcgtccctcagagaaggtccacgtgtcgtgacacacacactccgcttataaaggtttaaacaaacggtacttaaagattcaataatagaatggaaattgaatagacttgtgtagaactgcatttacgttcctttccagcgcccaattacttccatataggattttaacctcctgcccctcatctgctcgtccgatgccccctcgctgttttggcttctcccttgcctaggaaattgggccctattacagaacactcacgctgcgtctaattcgcgtcaaaatccgcttgcacaggcctctgcatcagggttgacggaggcagaggcttcttgctgggtggaggtggcgggttcgtccacaaccacaggtagaagccatg

SEQ ID NO: 6965 - DNA, 700 bp, Nannochloropsis_gaditana
ctaagtcgtcctaagttgatcttttttggagtgactcgtgtggttatggttatcgatcctgtaattgatgacaacagatcgaatcgtctttttgatgtcttcaatgcacaagaccgtttcgatgatcacatcccagatatttcaggacctcaaacatcccaaaaggatccaccggctattgaaacgtagctgccctcttcctatcgatccttcacacattttagcatttacgacacaaaagtcttaaaacaccagccgcatcctctctacacatttttgctcagaagtatctgacttctgtgacaaactttgcctttttaacactagccgggatcaccttcacgagaaacatgttttgtcagggttagggttagggttgaggttagggtacgtgctttccaaaaacttatccgacggcgccgggaggttattcgcaggaaacttgttctttaaagctgggagaatattgtgtcggcgcactgaatcgagacactaaacaaagaatttctcaatcaaaataggtaaaaattatgcgtgatagagcgttgcataatttggcatggaatgctattacctctgtacttgcttgtcccgtctctgcgctgcttctccgacgactttctaagacaatctaaaaaacgcgacaggtagtgttacaaacacgatgacacgcaaaaaaaatgctgcaacaagcaatatg

SEQ ID NO: 6966 - DNA, 700 bp, Nannochloropsis_gaditana; identical to SEQ ID NO: 6691

SEQ ID NO: 6967 - DNA, 700 bp, Nannochloropsis_gaditana
gtatgagaagatatagtgggaggatttccaaggcccgcgtgtttggctgatctagagtgcgaggacgtttatgactaacgcttgtcagctcggctagaagttggtggcaatccttgatactctagataacttagcaacagaaggagtagcaccgaacactcctctgacagataagagtatgtgggggtactacgcttgcactggtttttgttttggcgcatgaaagcttgctgctgggtaccaggggttgcacgttgaggaggtttttatgctgccagcgagccactggcgagaagaacaaaacttggtcgtcgaacacctggtctcctgtcacttttcaattggcttgacgtctccgtgctagcaacttgctatttgtagtggcgagcttggtgaagcgctttccagcaaatacacgcaatgtttagttaaagtgtttcgagtaacacgcccgtcgagagcctggagctgccgtgcaataagaagtatttgttgccggttgccgccacccgtttgctacaggattttaatggaacaattgaccaaccaaaacctattcattcccgtagcgacaagagtataaactgagaggtactaggcgccattgaccacaagccttaggaggtgccgggaaatagtaatccaccttaccggaaaagtaaagattttgcagcttaacacaacacgtcacagaacacga

SEQ ID NO: 6968 - DNA, 700 bp, Nannochloropsis_gaditana
ttattgagggaaatggcaataatggcatggtcagctgcactcctgtgggtgttgtggggaaaaaaaaggggtttcttgacttgagaccgggtcaactgcagagaaatattttgttgatgacgtccatttcgccatggaatttttcaaagcttatatgctgtgttctgattcgctgtctccgcgaagttagaaagatcatcaatcgatcattttgtttcatgtttagatctgcgcgagggaggaaagggctgaagtggtcgaagcagctgggggaaggtaaaatagccagtttcgcgcaaaaaaataacaaaaacaacgctttgcgtcaaaaattgcgatgtatctttacatgtgcatgcgagaaatgtacacatgctaaacggataaatgtacggtacatggaaagggtgtttcaaggctcaatcagtggtcagacgcgcagtgccgcctttcttggccatttcgagcgggcggcggaacaacctcctccccatcctccgtcggttgcaggccttcgcaaagcctgccgtgactccttaccattacatgcgcgtacgcattttcattataggcaaatagccgcttgttcggtttctcatgctttcaaaaaatggtgtgccagagcttgatcacccgcagagccgaggggcatttacgaccctcagcgctcgagacgtctgtccacactcgtcgactaatg

SEQ ID NO: 6969 - DNA, 700 bp, Nannochloropsis_gaditana
gcaagcgagcttcctgaccttccagtggtgacgcgaggactaggcgtttgcctgcgacgtaaggcgcattttgactagaacgaagtgttctccccttgtgcttgtggtcatacccaggtaacgccaaccattgatgccgaacgccagaatgatttctgttgggcagcattgtgaccactgaaagcacatatatcatcgcttcgaacttagcctctttgccggcgagttcgaggatgggccatggagatagaagcgcgggccagcagcaagtcaagggtaggatcagagtctcaagtctcacggcctggcccgtgcccgcgcttaggaagcgacctgcgtagattcgatcacagcgtggcgtgtgagtgtgcggcgacaagttcagacaaggcagggtgctggcgcgtgaaaaacacgtctggcggcagctgggcgtgggcgtgggccgggcgcgggagtgcggccaagccagtgacgtgtagaagaagaagagccccgcctgatccaccctttccgtccccgccccaccctgcccacgcgcaagcaggctctctccacctcaccatctacgtcattccttgcattttttgtcattaatacatcagatttagggtcgtgctggcgtgttgtcatttttacggagagagctgaagtcatgaaggcttaagatctccaagcgttcttgtcatccgtaagcatg

SEQ ID NO: 6970 - DNA, 700 bp, Nannochloropsis_gaditana
aaatcctagcatacaggattttcaatcaagaactttcagcattcgacaggtaatcacgacttatgcacgaccgttagctaccatgacgctattcgtacacacgtcaaaactgttcgagtagaaaagagaagatgcgtgaaaaatgtcatgaaaataattgtaataaatcgttagaaagctacttcaccatcctatgtcatctcctgtgtaactcgctcgcttcatggtcctttaaatttgtcgtggaccttaccccagtaattgtacgttccaccatccctggctttcatggcaggactcgaaacaagcccggaatttggaatcacttcgtacatcgggaagtattcttagcccagtgaagcctgcatcgattcgacgcctccgattagtcagcaaacgtgctattcaggaccgagacgattttcacatccttctatttggctcgttttgtctatgtttcaatgctagttttgtaaatttggtaaccttcagcagctacctaaaattagcaacggcgcacgtcactggtctcgtggctcgtgcctctcagacaatcgctgacggtgcttggcaactcgtctatctcccaatttctgtttttctttgcttcttggtggggtctgtcgttggaggatataccgtctctcatgagacattctatctaggtatgttgttgtgacgtcaaaaattttaaaaaatg

SEQ ID NO: 6971 - DNA, 700 bp, Nannochloropsis_gaditana
gcgaactattaccacgtgctacgtcgtcaggttcatcgggatttccgcaagcccttgattgtaattgcgcccaagaatctgctgaggcataagctagctgtgtctaatttggaagacatgggggaagggacgcgcttccgccgcattgaacgagagaaatgccctgacatccgggcgcatcatgagaaggtgaccaaggtggtctttgtgacgggcaaaatctactacgagcttttccaggagcgtgaagcgcgtggtatcaaggacactgccatcgtgcggattgaacagctggccccttttcccttcgataaggtcgctgatgagctcagccgatacccgaacgtgcagaaggtggtgtggtgccaagaggagcccaagaatggcggagcctacttttactgtgccccgcgtattagaactgctagtcgagatatattaaataaggatttgcaaccaatctatgtcggccgtgcgcccatggcggcaccggcgggggggctggcaaaggttcacgccaaggaacagcaaggcattttggacggagtttttgcattgtagatgatataggcggacagatacaaggagagcaggacaccaaaatggaatttttgatatcgatagagggaacagactgagagattcttgatgacatgttgagagattgaggggtaccctccgactgtcttgggtaaacatg

SEQ ID NO: 6972 - DNA, 700 bp, Nannochloropsis_gaditana
cacggctgccacgcaatcgcaaagccgcagccagcgcagctcgtcgccgagctcaactttcacgtgttaatcgcatgctagcagacctagaaaggctcccccaaagtattgaaaacacagaaggaggacagcttgatagctaaagtgcacagaaaaagtagacgtgacgttgatgacgactagaccaaaatcataacactggatctttgccggacaacagcgaatttttcccgtaagttttttttcatgtgcaattcataaggaaaaaggatcattgctattgtcagccatggttcctacgagtgttcattgctcctgtccgtgcgcggcatgctctccaggcagcctttcctgtgacgtcatgccctgtgaaggggggcaatcaaataacggttgaagattctaaagcacgacaactcccggaacgagcactacagggctaactctcatgcaggctggcaccagggcgcgtgagtcctaaaaaacgggagaccgtatgttgggattatcgcttttatctctgtacgcgtgcaagtggctttgcgtatgacgagaaggttatatcacgccatcaggttacataagtacaaggttcccgaactcgctgactcccgcatacatacgacgacaggaaggtaattgaaaagataagtggtactaagaaaagaccacgaaagtcgcgctttattctggcacgatg

SEQ ID NO: 6973 - DNA, 700 bp, Nannochloropsis_gaditana
acccgtttgcatcggtgcactccccccctcgcccctcttccctcacgtgctccggcgactggttagcaggacgttgcccttctggtgcattactttcatcacctaacttccgcttacgactgcttgtcatggtgctgccatcatcgccactgcttccgtttgtgcccccatctacgcgtgtatcgtggtgtgtgcgtgaagtgaaagaaatgcctaaaatgggcacgacctcctacgtcctttaccgccccacttcccattacctgcagcagaagacatggccgcgacctcaaacagagaaacctctgcccttgtaagtgtggagacctacggcctccctggaggtaccttgtggtgtaaaaggccgtcagtgatgagtaaccctacgcagagaagctcgcccccctcctccgtcgcgctctcgctcctctgctacaacccgggctccgacgggctgccaaacaagaatatgcagtttaagactgtgcttcaggaggcagacgcgcccgaaacctcacaaccctttttttaaaacttgcaggtcatgcatgtggtagacacgtgtcataaatacggtttcgcaggagttttgtgcctgctcaacctttcgtctgaggccatggcatggaggccaacagggcctgtataccgacaagcttcgcaatggtcaacgtgatgcagttctagtgtgaaaaaaatg

SEQ ID NO: 6974 - DNA, 700 bp, Nannochloropsis_gaditana
tcaggcggcaagagctgtgaaagagttcgcagagcttgtccaccgctacaccgacctcttgggccatccgcccccgtcggatgcgggcccgggcggcgccggggggggcgaggaggcggacgacaacagcatgggccacaacaatctcggggaagaggcagaagttgcagcagaaacggctcaccagccagctcaggaagatgcagcgccagcgccgaccaggcccttgcccgcagtcagggacttggtgcgagggctccttcctctggatacggccgccaggaccctcgtcaccgacccgcattgcctcacgcccgtccacccggacctcctgcaagtctgcctgggcgctggacggctccaacaagccgtggacttcgtgcgggaacggcccatataccgggtggacccggctgccaccggcgtggtagctctcgacgtgcttcggtacttctactacgccggcatggccttcctgagcctgcagcatctccacgacgcggtggattgcttcaaggcagtcatctccacacccgcccaagcgctcagtgctgtcgccgtcgaagcctaccggaaactcgtgctggcccatgccctcctccccacgcccgccaagcccctccccgcctctccttccccctcctcctccccgtcttcctcgggccccagcgccagcagcaccatcgctgccgctcaaatg

SEQ ID NO: 6975 - DNA, 700 bp, Nannochloropsis_gaditana
ccggcaggacccgacgtccctcgcacccaaaaccggggcgtcggagggtcgattccatcacccgcacgggcagcctcccctccactaccagcagcaacagccgcagaaacagcctgagggccgcgccagtgccccttcgaccgcctacggaattccccggctgggcaagaccctccttcaactcttgaaaggcggtatcagccgggcctcgagcgcctccaccgcgtccacctcctccaccaccccgaccagcagcagcctctcctcctcctcctcctcctccttctcctctgctcccttttcctcctctctgtccccccctgccaaccctcctccagccgccgccgccacccctccctcctcctcggtggcaggccccgccctgcccctcctgggcgcgaccacggccgaaatcgaccggctgacgggccaccgctccctggaagtgtacgcgcaaatgcgtcttgacgaacgtcggaatcggccttactacggcctgtcttccctgcctccttcgtgcccgttgtccttctccccctcccccgacgcccctcttcccgccgccgccgttcagcttgcctcccacacccccttcccatcctcctcctcccccgtcctggaagcccaagccttcctccaaaacgggcaccgatgccgtctggtgggatggttggtggcggtgggggacaaactccgcatg

SEQ ID NO: 6976 - DNA, 700 bp, Nannochloropsis_gaditana
ccttcctgctttgtaaaacaaacctccttctaaaaaaaatccaaactcacccctgtccgccagtaaaacccgccacgcctagcgcctttctcatccacatctgtgcaaacgttgaatttgggtaggctgtgttcggtggtatggttgggaaggaatgaggaaaagtgacgaagacggagactgctgcacggaggattgagcgatgcgggcttgccgtgagttctcaaaccttccgagaacaaccaaatatctcgcgaaaagcgccctctcgtccccacgaccatcgattacgatgcagacaccacgcacaagccaaggagacggcgggggtcgtgaggctcggtataggacgggtggggagggaaaagcattgtgagacgggcatgaggcgccatgacccgggaggagagaaggcgctcaagatcttggctttccacgtctttttgggatccatcatcgacggggtcggggcgaccactttacgaaaagggcatacttgtggacatgcgaggacatagggacagtggtggtgatggaagggtgggattgggctctgtgctcgtggagttggcatttggaatgatctctttcgtcttctcactctttctgcgttccatctgtacaccgtagctcatctaagccagagaaagctgtccccgcgacacgaaatctgtgcgagcctttcggccgcccttccatg

SEQ ID NO: 6977 - DNA, 700 bp, Nannochloropsis_gaditana
tgggagggcctgtccggcgtggaaagcaaggtccctcgggattcaataccaaggatatactgaagcaaaagctaatatattgctagtgacacgactgtgacagatcgggtaaaaatgttcatgccaacactcattccagccgtgcatgacttcccgaaggatgttatgcaatgcaattgatacgaggggaggtggaagcttcctcccggcgtgacgtgaggcccaaaaaagaagccctcaagtccgattctaagcatacaggcattcagcgcgcattgattactacgcttcctcaagaaattctgtactatatatttgatggaaggattgattcactaatttggcatcgtaagacaagctgggagaaaacgtagcgagaagaaataacaagccgcttccccgctgctatgaaggaaggacctacataaggcatcgaatttgttgcacaccatcaagtaaatcggtggcaggtgctgtccgatctccttgatgccagacgtttgacttcgtttgcatggtcttcggtacgagggaatagaattgatggttttggctattttttatgcctcctgtgggcccgctgcaacttcagctgtgcgggtcatttcgtgttgatgccatccatcgatttcacgcacattcacacacgacagaggagagtctgtacattacgaggaaaaaaaactgtgggggtgaaatg

SEQ ID NO: 6978 - DNA, 700 bp, Nannochloropsis_gaditana
gcgggccgttgatgcaccgcgaagcaagccgtatgaaacgagagttaaaagggacaatgctcagagtttgcccctttggtcgtgcctctttccttcacctctagcagagatatagacctgactctcggcgagtacctctcatcgcttagcctctccgtccacgagtacttaattacacgggcccaagctcatgctccgccccgagtgcagcaacgcaaggagtcgaaaggcacacttttctctggatatttggccccccatgccattatttggtgtgcattagctgaggtctctaacgctctcacacaacgatggtgctttcacaatttagaagggacaaacaaccgatttttaactctgatgcaacgtacgcgccggagctgaccagtcatgccttccaaattatcaaattctcttggatgcctgaaaatcgtggctttcacagggatcaatgcagatcaagtgggtgggtgcactctagtcgaaagtcctcgtgtcaagtgagctgctccatgacaaaccccaacttcttagacttgagacctccatcgacattgatcaagtgaattgtgacagattttgttgtgtttagaaaaagatgatcaaaaagatgaccgccgaaacacaaggtactcagctgagaatttgatacaaattaaattgatacgaggaaagtgaggggctctttcacttacacatg

SEQ ID NO: 6979 - DNA, 700 bp, Nannochloropsis_gaditana
cgcgttgctcggcttcttttgtttgtgtaggaagagtggaagggagagcaagacagaaagcgacgcgcgtcgggcgagggggcacttcatttgagaatttgggtgcaggaaggtgaatgaggatggagggtgggaagtgtggcgacggcggtaagacctcgctcccccctgcgatgggatggagtagcctgacgcgcttttgaagtgagagaccaaccttttgaatgagggagggggcgttcgaaacgccctgtatgtcgccgcagggaatgtaaagaaaaaaagggaggcatgtatgtgatccatgtttacgagtcaaggagagaatggggagatgttgtggaagtggagccgacaattgatgaaagaatgaatcgaaagcatatcggaaggacgctcttccaggtggtaaagagtactttcagcccatgctgaacctccttccctcgacctcctcgttcaggcacacgccctccccatggttgaaatcatactccccccttgctggagcctgtcccggcacggtactcgggggggcgccggtgccaaaggcttctcttcgccacgtccttttcctcacttccgcctgcttctcccacaggtggaggtagattcacaaagtcgaccacacgcatatccacaaaagccgtcttgaccaccctgtcgtccatcccccgcgcctctcccttcggccctccct

SEQ ID NO: 6980 - DNA, 700 bp, Nannochloropsis_gaditana
cccctgagggacagtcacctttccttgaagaagaaccaggcctatcacaaacctgtgtgccttgaggcatgcgctaggaattgaaaaatattcacagagcccagataatgtacattcgtgctacgatcatggcatttcatgctttgtttcaaatcatataggggtaattcgtcgctttaacgtggtctatgaaggaaattttcacacgaccgtgccgctcggctcgaaagggccgcaagatttaaagttttgaattcaagagggaagaaagtccaaaggagaggacggattttcccacattgtgtccaggtgcccgcgtggccatggaaaatcatgtggcacggaaattcaatcacgaacatggcgtctttctggtatatttacattgtgaagaattctgttcgtggtgcaccttctatttccccttcccccttggtttgctccctctcgcgccatgttccagttcctgttccgccgggagcaaagcgtttagaacgggttacgacctccgactccttctctcctgaaggtttaacattttgaagtagtgcatgttgggttagctgtttttccattgtcgcctgtcgactagtatggatggtatcggccaaaactactcgaaggttgacatcattccttaccggccctcgcttgttggcccatatgacagagtgccgacctatcgactgagaccgacatg

SEQ ID NO: 6981 - DNA, 700 bp, Nannochloropsis_gaditana
atagggcgacagctgacggtcgtgcccgagatggtcatgatttgacaaaatgtgccgcgacgcgacgcgtgcagtgacatgacaatgaattaaaatgcaattatatctaaataaacttacataaacatttaaattttcgactacagtcttgcctatgcattggttggctcaaattttcgagtgggcgcagtattcgcctggaacagacttttttcagcccggccttaacggctgaaattttgggactcctgaaaatttagcctggtttttggcctgcgtgtaggcactcttcacttcctcttcttttgtttcccttgtgcttcctttctctttgtttgtaggacaaatttatggcatgttttcctcttgcatgaggcaccttgtacatggtgcgttatcgtgttatgttcgatgaacctcctccctgtgtcatccgcgtgtacctgcaagaggagcatccccgttctaccacatggaccgcgaagcagtttgttctgctttgtttatgcaatgctgtagcatgtagtgaatacagctgacaagatcatactattggagacatttctgtcaaatgagatgcagtattcgatttggcaaagtcttcttaatatccaacttacgcttgcttttctttcctttcccgacaaatatgtaagcttttaaagcctcaaccaaaatttcaagaccaaccatcaaaatg

SEQ ID NO: 6982 - DNA, 346 bp, Nannochloropsis_gaditana
ccccctcctcccgccccctggaagcccgcgcggttttttacgtccagccagccatgccctcccacatcaaccacgatggcctcccccaggcggaaaaactctggcgattggcgggtggagacgaagagcggtgagatgaaaacgtggttttcaagccttccgttcatcatatggtgccccccttttgtgaggggagactagcatgtggtcattccccttgatgtgttcccctcggcgggtgaagtgaggccaaccccgtgggacctccagactgtcttaccctgcccctgtacccctcccttcgcccctccttcctctcggccataacgcaggtaccccgagcatg

SEQ ID NO: 6983 - DNA, 700 bp, Nannochloropsis_gaditana
cactcaggcctcatgggccgcatgtactctttgaagattcaaaggcttacactgtctcatttaaagctataaagttatgagatccatgctctgtagcgtttaagtgtcctttagtgcggcggcaacctaagccctgatatatattctctgctcagagaatgacctcccaagacagtaccaagccccggcagacacagagcgaggaggtcgtagctaaagccgctatcagggccgcgccgacatgtccttcaacttcaaaggctaagacttggaacccggtggaacggtctcataggcgcctggtgcacacagattggagagagccgactgggacacacgatttctaaaatgcctcgttaggtgattgcctcacgccttgtgagggcggagggaaatgagagagaacgggcgagcgtcttgggcggcagcacgcgacacgcaaggtgacacgcgaacacaagcatttaattgcaagcccacccatgagtcgcagcactgcttttacatgaagagatggtatattttaatcatacgtgcaaggacccatttgtgtccgtgagctcatttattgtaaggaattcgttgagtaccccccccctatattcaaatttcgctggctagacaaagaggaaacacgcgatattttcaagcaattttttaatcattttagcccttaagtccaacagttgtcaacaagatg

SEQ ID NO: 6984 - DNA, 3 bp, Nannochloropsis_gaditana
ttt

SEQ ID NO: 6985 - DNA, 700 bp, Nannochloropsis_gaditana
gttgtatatgcacctctatgagtaaaagaagtaatcatgaaaaggagtaagtttcttgtgagggcctcttcattttctgccgagaaatatcgccacttctcgttagaggagctaaatgtgacgcaaacgagcggattaccttgaatgcctttccaaaaaagtcttcgagtcttcgtgcgagcatacggcaaagatcgtggaagtacatgatgcccttataaggacccgcgcctccgtataagcggccataggaaggcgacctcgggcacgaagacctgaggaggagtcggaacggggttgtgcccttcctgggaaaacggatgcagtacgtagcactgcaacgagccatgaaaatgtgaccaatgtccagattgctcgttcattaacgacagagccctctaaaccctgagagacggctttgggggcagtgcattggcctcggacgccacgcatacctcccaccaggagcagcctccttgaagcggcgctggacgagccctgccagtgcacgcaccctgacgcccctcgcggtccctcttacacccttcgcgcgcccttcccttctttccacaccatcagatttggacattgtgttcggtgacgacattgcaagctcctgcggatggtttgaccacataaggcttgcggcgtcgcgcaattcgggctaggaccaggatcatccctcttgcttccgagaatg

SEQ ID NO: 6986 - DNA, 700 bp, Nannochloropsis_gaditana
acattcgacaagttcgcgttctcctcttccttcttgcgaatatgtgacagaagagaagtggaggcttcatatgaattatatatgagttttaaagaagtgtggcgcataattttttcgacacgcttacccgcctcgctggatttacgcacttatcgaccttattacggggatgctcgcgagtttgggagacattgcacgatgagcgtagagcccgggtcaaataaggattcggtgcacgtcgcaggccaggtgcaagtggcagcgcagtctcatcgtgttcttctttgttcgttgtatgatattccatgttgcgtaccaagtcgtgctgaaaagcttaagtttcaactcgcgaacttctaaattgtcacaagtaaaattagaaagtgagctttgtgagtagaaaaattgtcagccttaagttcttcataaaagtgaggattgcagcgccaaaaacggcacaaatatctttcttatccccataccactaaacaaaattcaaagataagaggcaagggcaaaagcatccctaaaggtacgaaaaagggggttcctagggctagccaagtaacggctgcccgttggccgttccgtcgccattcgccgaatccgaccggccgtaggagcctccctgacccgacgcccccgctgtggatgtaaccaggcgcaccacacggctacacaggaaccacttctcttgatg

SEQ ID NO: 6987 - DNA, 700 bp, Nannochloropsis_gaditana
gccagcaactggcggggaaggctcggcacggcttcgggaggatgttgtcacagagggaggtgagattttaactcggcggcgaagtgaataaaatgcttttttgggagacactagaaacaagtgtatttcacctgtattcatactaattggatcatcgacctccacggccagggcccaagatgcaggctcaggtgctggaaaatgcacaggaaacggcacatggtcagtttgtcgtcccgcttgtcaaccgcaagttgtagcttggagtgaatacacaacagacataaggcccctcaattcatgtatgaacgcgtgtgttggcctagtgcacggtggtgtgttgtaaacggacgtgtaagccaaagtaaagcctggatcctacaacctccccaccccctccgaggagtcctcgctcgctctccgcctgctttgtcgcttacttgtctgcaaggtccgtgctcattctctaccccccagccttttcgttaacaccttgaatgttgtgcatgatgataatgttccaatcagtgcgattatgcctttcgagactctctcctcttggagcgcaagccatctcagcccgactctccctcattgcctcttcctcgcacgtaagatctattggaggtttggcgaatggaacatggcttctcctgcctcaaacatgttatcacaacattcgtcgaaaacatcaagcatg

SEQ ID NO: 6988 - DNA, 700 bp, Nannochloropsis_gaditana
acccagtaactgccaaatacgacaaagtccgacaagcgacttgcgcctggtttccgacacgatgtccaacttcgtgagagccctgcggacttcgaagcggaggcagcacatgattcatatggccactaaactttgaaacgcttggagctgggatataaaatgtctgtggcagtaaactcggccctctggcgttgcgttgcaagcctgcaggcggtagagtgggatagccaccgcgcgggaggggattgaaagagctgaaggccacagcgagcggccaagtgcatgaagacacggtgaaggcgaccaggactttaggcccaaaccagccgcgaccacacttccttttctttaatagaggcatgcttccctgtgatgattaatgcgtagattagtgtcatccaggcgcgttgtttgaccctggcctatcttggcaattcaagcgctcaagcagacttggcgagggcgaggccaggcaacgggaaacgacgtgcggcgcctcctcgtcctcacactttcaaaagacgtacaacaccggcgcgaagaaccaaaagtcgaatgtcaaagatgtttatcttattgtttcgtgacggaacatgcgagtggtaggcggtgtaccgtaggctgctcggacgccgacatctccccaccctcaccaattcctcgatctgctcacaggcagggctagagccaccttgccatg

SEQ ID NO: 6989 - DNA, 700 bp, Nannochloropsis_gaditana
taaggtcatccacggctttcttcagccaaggaacaccacttccacaacacggtcacgcctcgacccttcccattcagggggctcgggaggcaccttcgaaatggcgggcttcagacggttcttcgggtggccggccctgggcgacaagtccgatccggcctgggtggccaaccagcaaggtaaggggatcgttccttcgtaacggcttgaaaacaaaggttatcgtgagagagagaggagggagggaggactgacacgggtggtaggcctctgagatgaaaggggataagtaacgtttggtgggggggaggaaaggaggaaggacccgatgaggagagaaggaggaggtcaaggagaaggaaatgcacgggagggaggactttgaatggcccgggacagagaggtgtgtgcgttggtaaggtaggtacgagaatgcggcctcggcaccgggcttggtcggggaggagaagagcgtgggcagtgaatacgatggccgagcacgcgtacaggcgactcgtcgagagcctcgatcgctgatagcgacatcgatattgctatcagacgaggagagaagttgctgtcgagagaagccacttgcccgcggtccacatcattgagccactctctccagctagtccgaccttccctctccctgatccctccccgatccttccttcccacaggctggatcaccgccatg

SEQ ID NO: 6990 - DNA, 700 bp, Nannochloropsis_gaditana
cgttcctcctcctcctttcgtgcgagatgagcgtccgtggaagccatccctattacgtcctcgttcacggcgcctttgcattctctcgccagtcttggtacctgcagtatggcaagaaacaaaattactattacagcgccggtcgggttaagttttgatgaaaaggaatggttcaacacgacattgcatccatctcttaaccagcacccaaccaatatgcggccacccacacaccgtggggttgtcttcccataaagtgacgacaccgtcatgccgagcagcggcatacatagctcctcctctcgaccagcaaagcgcgcggatgccgcgcgctcgttcctggcggccagccacgacgatgcgttgaccctcgaggtcgattgatttgagcaaccctccctcatcccccgtgatgatgcgcatccctgggataaatgagaaatgccaagtcaatttcctgaaaacacaacgtctgtcgcggacatcacccgcgctccttctctgcgtgtttcggccgcggggcgccaggccatgggggaggtcggccatcaccaaggacggcatagcgacgagtggaggggcgagagcagcgaggtcacggtcgcggccttgcccgccaatgaccaacccgttttttctttggggcggtcggcaccgtcttctctaggctcacaatctacgattccgtcgttttatccta

SEQ ID NO: 6991 - DNA, 700 bp, Nannochloropsis_gaditana
gggcataatttcatatgggagctgtcacattttttgcatttcttctcgtaaaaattggaaatagggaagagatcggtgcagtggatggcaagtcagtcgccatgagcacagcccggctcacaaaaagcgtgggaagagcctccccgtgacataacccgtgtcctggaagaacatatctgcacattacacggcaacgacccattttatgaaaatcatactgcgcacaggcggaatgcactcattggtcacgtgcgatccgatgaagtaggacgccattcacgcctggcaaattttcgtacgtttgcccgggctagctcaacatcaactcgcccgttggccgggcaagggcgtaagcgagagcgagggcttagaacggccacggggactcgcaaaggtatgactataggtttattggctcgctatgtatgagcaaatgatgtgttcacacgcgtcttcttaaagtgtgtggtgtggtgttgtgtgtgtttttcccagcagtacgagcaggcgaggagagggagtgttatccatgtcgacccctggcatgggccaggaaaggtcaacagaaagcaggacatgtcaagaaaattgcacattcgcgcattatactttcgtacaaactttttttcccccaacatttcccaaatttgagtatgaagctaagctactcttatgatgtcggcagccgaaatcggacaag

SEQ ID NO: 6992 - DNA, 700 bp, Nannochloropsis_gaditana
ttgtgtactcgcatcagtcttctgacctaccccgccggtcatcctttcaattccaagatcagtgtttgtatgcaccctgtcggcgggagacgggtgatcgctgagtattggtttggcggttgacaaatgcgagcgccgctcgtactataggctctaacaacgcacacaaaatgcgaggaaggcggtataaagccagaaattgggaaaaatactcttgtcagccctatgcctgcgtaaaggaggacccgccaagtaaggcgacaaaggaaagaaaaagcgaggcggaggcgaaagagcgagcgctgtgtctttcgggcgcaaagaggggaacgttcgaccaaccaacaaatccgcgcgcgcgacaatggacggtaccatgagaactggaacgtgcatgccggcgtagggcgtgtgctcttcggcgttcttttcccttcgcagtcgtttgaggccggaccctttttaagcccccttacgccgtctggcttcattcccgccctcgcccacacctcgtctcacaaatttcacgccccccaccgcaattgacgcgctagtacatacctaccccggcatagaccaaaactttgcttaaagcaacttggaatcttactttctttttgtctccagacagggaccttctcggctgttgctattcgtcatcatggagaacgccagtgcccaaacccccactgccaggatg

SEQ ID NO: 6993 - DNA, 700 bp, Nannochloropsis_gaditana
aataccttcttcaattgttgagcttaatttttcagtactggagcccacttgcatgggttgattcaatacattaccaggctcggacatggatttgcactgtcttggccatgaacatgtgaaatgagacgaccgagcgagatgattgaacccagaaacgtgattcgaagtgacgtctctatgtttactttgagggctcaattgaatgtaacaggaagcgtagcctcataaattttgggctgtagactagtgtgcccacccacatgatctttggcaaggaggaggtcaggagggaagcgaggcaaagcgagagcgacgacgttttgtgcaagcatgtagtgccagaacccattttgggacaccatttggaaaaatcatagatgtgtgtaggagtaggatgaggactaaagactctcttgttcgcaagcagccagcatatgacctcttccatcgtgggccacgcccctaaaaacgcttcatgcaatgccgtccccctcccaccccaacacagccttcacaaaaaatcgtaggcgaaacataccacattccgtccattgtcggcgctgatttctcaataggcggccaaaggcgccgacgacacagtcgaagtcagttggggaagattcacgggctgcaggcactcttcacggctccaacgtgctctgcagcataattttcgtgccaacattggtggtagaggatg

SEQ ID NO: 6994 - DNA, 700 bp, Nannochloropsis_gaditana; identical to SEQ ID NO: 4745

SEQ ID NO: 6995 - DNA, 700 bp, Nannochloropsis_gaditana
gcacgccaacagccaaatatcccaaccacaaaacaagtagcttcatgtcagcgaaaaagcgcctgtcttatgcatgtcatttatccatgtaagcgacgcagcagtctcatcaagcatatttccatgtacaggagatttataaccatacaaagtgagcttcctgtttgcgtcgcgactacccttcatgcaaaagactcattgcgattcgagcaggcatcgctttggactgaaggcggcagctactgctggtctgacgtatctagctttctattcgctttttggaaggtttttcccgacaagtcctatacaggatcgtaagacttttggggacctcgaaacatttgcctttgacgagaagcccttcacccgagcttatggcgataaattcgagctccttcgtccttggtacgatatgcgggcgggcgtgcatcaggcacctcagcttttggcgtcaccagagtcttggattgagcagttgaccctcaggctcaaccatttggactcgaaggtggccgcaaacactgaccggtccgtatcaactcgcaccagggccgcttatcttgaggttatgaagctgtacgtgtcaggactggcgtatgggcccgaagagatgagtgtgggagctgacgcaacaattggtccctttcaggctgataagagggcaaagggcctggactgggcttaccttggcatgaccatg

SEQ ID NO: 6996 - DNA, 700 bp, Nannochloropsis_gaditana; identical to SEQ ID NO: 6995

SEQ ID NO: 6997 - DNA, 700 bp, Nannochloropsis_gaditana
  misc_feature (1)..(464): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaggaagggggggagggagggcttgagggccgcactgggtattgcgacgcatggggatgggaaagggggatggcgtggtggggagggaggagagcatacgggagaggaagaggaaagcggcgggagaaccaccctgaagccttccttcacgcctccatcccctccttccctccctcccttcctcctttcctccctccgttgtcctttctgtctcccaagccggtctaggcaatg

SEQ ID NO: 6998 - DNA, 700 bp, Nannochloropsis_gaditana
ggggggaagaaagagacgagtgatgagggagaaaggtggcgggagggagggcggctgggcggccgaaagcgaagatgccgcgaagctggacacctcaatcggagccgctcccttgtccttgaacccttcgcaggcgctcctctattccgctttccgaaattggcgcgaaacctcgtttgctcgcctctaccttcccttctcctccacaaaatcccgccccacctccaccacctccacctcctcctcctcctcctcctcctcctcttcctccctctcctcctcttcctccctctcctccgccgcttccgggccgtcgaacgcgcagaaccacagcatgctcgaccggattcgccagcgactgagggaacgcgagggctcttccgccgtcgggacccctgcctttccccctccctccctcgtctctccacctcgcaacggcgaaaagacggctggggaaggggaagaaagtgaaggggggaaggaaggggaaaagcagggaagtcttccagctttctcctacgcccgtagctcctcgcacttgggaacagtcagggaaggggaggtgcacgaaggaggagaaggggaagagagggcgacagggggacaaggcgggtacgaggcggtttctaccatttcttttgcgtcgtccgtctcgagcatctctcggcacggggcagaggagagagagggggcgaggatg

SEQ ID NO: 6999 - DNA, 700 bp, Nannochloropsis_gaditana
gagaaagccacagcctccaccgatgggcgttgggagtggtggggtacgggtggagtgtatatgtctgtgagcggaaggctggagccagcgcctggagctctttgtctttgggaatgggatgtcacctggaggtgatcggtacgccggaacccctgtgacgggcaacagcctatactcgacgtgccccggtcggggtgtgactgtggaatgagggtctccccacctcaaagcatgcgacgcccgccttgtaaagagcacgggtactttgaaaataaaaggggcgtctgacagatactccacggcccaaggctggtgaccaggcaaggcctctaggttgggctctgtcctccacccccgtcgccgacggctttactttcactttttcttactttatttcacatctccgtccacgctctctgggtgcttctcgtcttgtgcccgcattgcccggtcatccctcgtcatctctccaagccctccccaccccccctcccctccgccctcctgctccatgtacgtcagtaggcgcttccgcatcaatgcatgcaccatcctagccccgtccgctgccatttccaaggccctttcgctccctcgagtgtccagacgacccttctgccatacttgcgtgacttcacccgataccggcatcaaggccaaccctaccacccctccctccttcccaccctcccgtccgccc

SEQ ID NO: 7000 - DNA, 700 bp, Nannochloropsis_gaditana
  misc_feature (1)..(139): n is a, c, g, or t
  misc_feature (686)..(695): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgccagcagccttttgccagctctgggggtatcccgggatccagcgttggctggggaaggcaacaaaacgtcaaagaacaagtcgcgcttcccaggcgcgtcctccacgttgaagtgggcgggggggccctacgaggtcacggtcctcttccccctggtttccgaagaccctctggtcgagcagcggcagctctgcagcctgggcgaggtcagactcgtgttgtgtttcctgggaggggggagggggcacgggactaagccttgagtcgtgtccttcgcatgcaccttcccttgagcggtacctgcatgggaaggaccacgcggatgtgtaggggaaacgccgcgtagagtgtggtctgtgaattccgcaactcgctcataccgtgacgagaaagctgcctaagcgcccacacgcgtccacacgccctgtctcccttttagcctccctgatatccttaccgcctcgccacggcctctctcttcccatgcctccttttttccttctcgcaggccatacccgcctttgggggctcctcacgggggtnnnnnnnnnncctgt

SEQ ID NO: 7001 - DNA, 700 bp, Nannochloropsis_gaditana
ctgaaagctatcttcggatgcaaatggtactccaataacttagacaaggatatttgtttccacgcaagctaatcttcatatccccaagctgtatactaaaacagccacgggcgttctttcttggaacgaccacgtgccacgtgccttttctcatagcgacgggggcttttctagtacaataatgctactggactgccagcgcattcatttctcgcatgtttcctaatagaattgaaataaattgagggaggattcccgtttacgcacccagatggttatggaatccccttatttttcatgtgccgaagctgtcacttttaaaccagctttggcgatgtttttgaaatgaccatatggcacgtgccctttcttcgaagaatgggagtcttccttgcggaatattgtttctggactgctgatgcataactttctcacgtgctggccacattgtctgttgatgtctgcccacgaggtcgtagcatcagctcctttgtttcatggcacgtgaaagagaacattgcctgaatcccgtggacgcgaacggaatcaaacagacattcttgacatggtttagtcatctaccacaccttaaaaatctttgagacattgtatatagccgtacaccgtttgatttgtgtatattggactgatgtttgaggattttcttacaggtcgacctgtcccgatcttctaaaccaat

SEQ ID NO: 7002 - DNA, 700 bp, Nannochloropsis_gaditana
cccgctcgtcggaccgccaacatgccgctgtgatctcctggtgggtgagaaacagaaatgaaacgaaggcttcgtcctctcattgctgttgaagcggtcgtcttctcgctgactttcactttctcgcccagacagccgagtcgtttcccatgcccgcctcacatcataccgcgctttcacgccgaacccatcccacagatggagcatttttaggaaagaagtagcgtccgttgctttggacgggacaatatcgctctcattcatgaaacgcaatggcggcaggccctaccgacggtgagatgagggaggaggtcaccacggtggaggacgaggaagctgagtttctggcctacctcgctgctgctacctccaagaccagcagtatagacgtatctgtattcttgctgcccgctagatctgatttcatggcatttcaaggctacatttccctcggagtacgtgcaaaaacgctcgccaggggtaggggcagaaaggcaggaggtgtcaggtttactgaggcagaatttcggtgtgcctcgcaactaagtgtttctgtatcttacatatgtgctccttgtgcttatccttagatgtaccaattgccattgtatttttcatgcgaaacgcctggagggcgcgtgcggatgtcctccattcgaggggactgtcgattgcgcgccttgtggaagcgaggggaatg

SEQ ID NO: 7003 - DNA, 700 bp, Nannochloropsis_gaditana
  misc_feature (1)..(626): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgccgcacgctccccccccccgccctgatatcacctgtacttgttgctgctggcgacgcggacactgcggatg

SEQ ID NO: 7004 - DNA, 700 bp, Nannochloropsis_gaditana
cgacattcgcttttccagttgtgcgcgcgccggtatggatgaaaacgtttgcgccgagacattttatatcaggagatggcggtaaaagtaggtcctgtatgcgagagccggggcatatcgtaaaatcgtagtttacacgcgtttcgcaatctatgcccacagagtcctagaccgcatacaatttcacataaaatgtacaaaatgatcttgtgtacactccagaagcgcggcgaccctttgcgtccttgtttgcgagtcgaggcaaggagggagaggggaggttcggggtggtactggaatgcactggtggaaattactttttggcatggatgagtttgtgcatgtaacattagaaaaaggcctgtttttcgttttctgagaaggttttgatcaaaagcatctccttgcgaaaagaagaggatgacttcagtcatcgattctgaccttttggggatgggtagtcttacaatttgacgcctatgttcgccatacatatcttattgatcgatatttttttgggccgctacttcctatcctgaatattgttttgtaaagcactattatcgacaattgtgtagagtagatataagtgcttcgagaggaaacgaccgctttctggggacatgacggcgaagaggtcagagagagatgaaagcttgaaaggcgaggaacaagtgcgtacacacattgtagcgtactt

SEQ ID NO: 7005 - DNA, 700 bp, Nannochloropsis_gaditana
acctctacccactcctacagaacaatctcccccaaaacaagtttttaaaatgtacccctcaagcatacacctagctcctgcagtgacgacgtagagcacttttttatcctctgggtttcccctgtggggagtccgttgccgggatcgcatcctccgcctgctgtcgcgagatcagatcctggcctgaatgttggtcattcgttcgtgtttgcccgcgcgcgccgtcgctacggaatccataccacgcaattctgctggttggcgggccacacatggtatgatgggctgtcttggtgtggcgcggcggtctgtaatgctgggtactggcatttccgcgagacgtgatgtcgatgagcgggatgggcgacacaggcgatgcaagcaggaattgcaaagatcaacgatgcaagcaggaactttcacaagtggagaacataagggtgtccacaccatttccctccggacatatgacactatttttcttgtttttccaaggattgggaaataggtgcgcgtgagatttcatcctcatcgtcctcgcatctttagctggcaagcttcgacgttgtcgacgaggatcgagaagaaggttgacatgcgggcggtatatatatgaaccgattttcacacaaacatttacttctcataccttcgcaggactagcatgcccacacggtagtagcacttaacagacaacatg

SEQ ID NO: 7006 - DNA, 700 bp, Nannochloropsis_gaditana
ttatcaaagaggccatcttccgcaggaaacgcacttgaaataagggcctagacaggagcaaaagagatacgtgaacatacctcgttcaggacaatccgcgcagatttggttctcaggccgctttaggagatcctcaagcctctttttattctctgcctgtacaggcgtagtccccgaaggcccagaacgacggtaggccatggcaataaataaaggtgggctagagcgtgcggtgctctggcttcctgcgattggggcggcgggtgagaaggggacgggcatgatattagcagggccaaaactaaggaagagatgataacatcaattcttagcatttcgataatatctgctcatccaaattggaaggaaagtggtcctaatgcttgtgtatgggggcaggaaggagtgtacgaggggaagtccggtgggcaaggaacacacggcagcggcagcgaggcaaagcgccagcgatgtccgataagcggggacagaccgccgtacacctgcacaaatccactgctcattccattcgactaggtgactcgtcctgaaaacgtagacgtgggccgcaacgttcgtaaagacgcggtgagtgaccgacttttgcccgcccggggtcttctcttgcttggcgccagaagccagcaagcgagagcaggcgcacacgtacactttacaagggttcgatagagtcctcatg

SEQ ID NO: 7007 - DNA, 700 bp, Nannochloropsis_gaditana
aagataagttaaatacatatttcaccacgatttaccaagagccgtccacgtcgatgcatgaatggacgagtacatatggagatgaaggtatgtgggccacacatgaagataccatggtatttctcgcaaacttagcagcgccctccatgaaacggagaagaagtgcatcgtaacaacaattttttcataattggacgtggaaatatggtaaacgagtggatccttgcacaaaaagcgtgccaaggagggtgggaaagggagggagtggtctttttttccccctcaacccacatgagagaccagcgactcggaggacgtgatggaaaaggaccctcccttggcctcgaaatagacactgcgcgggacacagagcccaatggccgcttgaaagggcctcgcttaccgtatagtatagccggccctggattgagaggcgaggggagaggatcgtgtggtgtttgaggctttttcaaggtactttggaaaaaagaagggcaaatgctttgtctcctgcagcaccttgatccgcctttacagacgatcgacagcattaagaaaatacacgggcaccatatagcacctgaaatatgtgagacattcgttgacaatgattgaccgcacacttgttttcccattccgctctcatacgcaagtctgcttcttgatcgacgccccgcccagggtgcatagagggctgatg

SEQ ID NO: 7008 - DNA, 700 bp, Nannochloropsis_gaditana
atgctaagcctttgtacgactgcctcttcttcgccggggaggccactaatgccgagcatccggcctgtgtggatggggcttacgtaagcggagtgcgggcggcgagggaggtgaaactagcgacagagaaaggataaagcttgagtaaggaagatacatgtcgcgaaaaaacatgccagtataataaggaaggcgctcgaagtaagccaaacggaagaatcaattcttaaaattagggccagccgcaagtattcgcaacttgggcggcaatacgcactgaaaataagacttgaaaagcaaagttgagtatgatagaaattctagaatggaaagttgggagcgtgattcattcctaaagttgcgtgttgtacaatcaatcttccttggcaaagcgttgtcaatgtggacgaggctatttcccgcatcaaaattcgttggattgcggtagctacgcttggcacttgtatcatgtcaataactatgacacattcatacatttccccagaaacgtgtcgtgttgttttcatcaaatgcttcatagagccatatgtttgaaaataaaacgttctcaatgggccgggggtgggaggatatcgccccaacgctagctcgctcatttcccatgtccgatcagtgttacgttccatccctgcgctccttaaaccacacacgttcaccgaatcggttccacgacaggatg

SEQ ID NO: 7009 - DNA, 700 bp, Nannochloropsis_gaditana
aaggaggaaagctgcatgctctgcagagggagaaaggggagggagggcgcggtggaaagacaggagtgagcaggaggcaggagcccgtgaggcgtgagcagtcgaagcaaccaaccccacaaacaatgccgccactgggcgcccaatgctttcgacaacgtctcataaacgggcgacatccctctcgtgaacggacgacacggtcgccgcgtgcctgcgcacgacaggacaagaattcctcccctgtacccctgccaatcttctcctttccctccttccctccctccttccctccctccttccctccctccttccctccttcccatccccctcgcacctgcgccggggagaggggtcgtgcgagagagtggaggaggagctgacctgggcggagggactgcaaggactgggagccgagggcgtgcaaactgtaaaaaggggggagggtgtgggagagagggaacgctcgtgtcaggagggagaatgacggccaagagggaagggatcacggatgctcacgcccgcctgcacgccctgcgttttccgaagccccccttcctccctccctccctctctcccctcccgccgtccctccctctacctgtctgctcgtgagaccaagtgctcttccaggagccgaggcgggacggccacaggaaaggtgacgttggaggcagggaggacgatggggaagatcatg

SEQ ID NO: 7010 - DNA, 700 bp, Nannochloropsis_gaditana
aactgacgtactgcaccccggcaaacagtcttctccatcaagcttttgcacgtgcctacagcgtcagggcgtaggcaagtcgtctgctgtcgctcgctagctcggcccatatccttttgttctttttccccgcgacgaaggaaggcacataaaaaagtgcggcccgtgtcacgtccggcatcacatcccaatttgacggcgctcaaggtatacaaggggcctcgattgtgcgcggaacgaggattattaccactccatttcacggcttgcgcatgggctttcgttcgtaacccttgcatcacagtgatgttcacctgattcttgacagacagcttgaagctttcagaacacctcgtgattgctcctcacctgttctcaccaacaacagttcataaggtattttaaaatcgcgatgattaatgctctcatcttccgactgcgtggccgcttgtcgctcgtcctgacaactacgacgtctcgtatagagcggcggcgcctatgctttcctgtacgaggttacccccgcacgctcacgactctggggagtccagacgaccggaaaatatatccaccttctacttctagtgttcctcctacaccagggcgccctaccggtggtgatccgctaaaagacctgaagaaagtccacggctcctttatatcttcaccttcaactatctctcatcgagaagaggtcatg

SEQ ID NO: 7011 - DNA, 700 bp, Nannochloropsis_gaditana
gccaagtgtcatgcagatcttgaccctccccctcctctccttctgctctcccacttggatcattttattcgccctaaggaattgggtcgtccatgctgaaggatatcggggaaatcttggagtacggtcggctctcccggttggaagctttgaaggtaccgacgagagagagaaagagagagaggaggaggggaagggagggcggaaaaaaagtaggcaggacataaaaggcccatattccaggatgccagacatttggcttgcatgtcccatcctaactctcctatccccccccctcgctctctcttcttctttcccagcgcagagagggcgtggaagcttgcctgagcttccagaaggtttggggcgtcggaccagcgacggccagggcgctcttcacgcacgacaagatacagagtatatcggagttgcgggtaacaatggattgaaggagggagggagggagggagggaggatgggagggagggaaggaggagggaagggaaaaaggctggcgggcttttgacgaggtcgtggaagggacaggcgaaaggaggggatactgctcgcttttcaagtctgacgatgtctctctggggtttccattacgccttgagccaggaagaaggagcgattcttatcttactccgcatgattgtcattgctttcgtattcactaccttgaccttctactctcatg

SEQ ID NO: 7012 - DNA, 700 bp, Nannochloropsis_gaditana
ggaagtggaagaagctccgcgaagcaacgcgtgccactgaccgagatttgatttcttgagtggtgctgcctctctcctcggatagccgtgtgcttgcctcggggtagggaagatttgagcaaaataaaaaaggcatcggtaagacacagcactacgtcctactccacgccaacctcgaaccaccgcttttctcacccctatttgcacagcacatgttaagcaaaagagaaagaccagacgcttcataatggaatgaaagataaatgggattggaatagtgactactgcgtccttctcccttcgccgcaaagcaggaagatactactgcttctaggactaggcgagcaattgtcgttgagagttgagagcggtaagacttgtcaatgacacgctcaacttgtaattaaaatgaaagtatacataagtaaaaatttcaagaaccgtaacgctcattaattagcaatcattgtgagttcaccagtaggcaagcgtcgggatcttgcccgtttcgaaccgttcgttctgtcttatgcgtgaacaaagttctttgaaaatttatggagtcacatagccatatttcctaccccacagcagatgaagcactgagttgagcaaaaattagacagcgccgggctgagcgagtcgacgcagcttaccatccgacgattgaccgccactgcagtcctcccattctttcatg

SEQ ID NO: 7013 - DNA, 700 bp, Nannochloropsis_gaditana
ctttctgtcctcccttgcccctctcccccccgccctccccgcacgcagccggccctgccccgccttcccccccctcacccgcctcctcatctcccccctcgatgagagcccccttcccctcccccgtatgccacaccttacgcgcctctccttcgctgcccggacccgcaactgcccaaccctccacatcatcttcctcctcctcctcctcctcatcatcatcatcctcgtcatccttctcctccttttcctcctcctttccctcctctccctcctccttcttctccccctcatcattttcctcctctatccgcacgaacggttgtaccgagagcgccgctatgctcttctcaaggcgctgcacctgccgccgacgctccacctccccctcccctccctcctcctcccccccaacctcccctcgctctcgccgctccttcgtgtgccgccccacgctcccttcgtccagcttgaagagcaggcccaggcccatctccagcggctgcggcgccaggaagttcttcttcccccggaccatgaaggacccggtggggagaaactcccccgcgggcgccgtcttgctcacctgccccgcccccacccaccaggccgacgtgaccatcttcgccttccatgccgaggaccggctgacggccagacagcccgcctcctgcagcgctacgggggagacctctgcccc

SEQ ID NO: 7014 - DNA, 700 bp, Nannochloropsis_gaditana
agcatgctcacatcttggaagagagataacagtacgatttattttgcaggtatcgtggattcggcgagtcttcctccgcttccaacgggggcgaatatggtttccatcaccaagtatgaatacgtcagcaacctccccccgattttatttgccgaggcagcagaagccaaatcgtcatagactctcagaaagatcgttttagaccgcaagccataaattaaaatgtacaattaagtgtgtaatcctagacaaatcctgaaaacgaaatacaacgaacatctttgaatcccttgtcagctaacttcgccattcttctcggcatgaaaccactcgcttcttctaggtatccctccctagccatgtttgactcatgattaggactcttaaaaaacaaatgtcttcaatgtccttaatttcctccaaatacagccgctgaaaaattggtttcgagtctcgatttccgtccttttaaaaaatacccccccaaggcccgagtccctctcgctggcggcatcacggcgagcagcctgcctgacactttcaggtcgcccgctttcgtctgcggcaaaaatgtcacaacacactgagccgacgacccataatcagctcaactgtgcacatcgtaattttataggacaagaagctgatagacgattaagaagccatcttttctgcgccataaaaccgcgctgccaaaatg

SEQ ID NO: 7015 - DNA, 700 bp, Nannochloropsis_gaditana
ggtcaggcgcgagtagtatttctcgattatcactcgtgctgatttctttacggtcttggtacgcacaccctgaagatatcatagaatagagaaagccccgcacttatactgttagaaaggccaacacagttcactgacatctggtgacctctttcttgaaatatgtgaacaggatagagggcgagaaaaatgcttcggactacaacagtaagaaaggaggacagtgacatgcttgtgacttgataaacatgttcttgatcgtgaaattgttgtacaaaagcgaacacagaaggtcgtcatgagcagactacgaagggaagaaaatgcgctcgccctgccaaccactggataagcacccacagaaacgtaccatgattcacagctgctcgtgcaaggcagattggtcctgggcgaatatcggatgatgaagcgttagtaaaagtcgccatgagtgtacacagggagagcccgaatgactccttgtgaagcacgaggggtggatggtgggagggaggccctgcgcgtcgccaaggaaagcggcgcgggcgcctccacacgtttgtgcccgagaccgctgtacaggcgacagtcttattcttgcatgtgagtgacccggtgagacgtcgatgctgatacttgccatccatgcaatctttattccgatcaacatctgttgacagggactgaccgtagacgtatg

SEQ ID NO: 7016 - DNA, 700 bp, Nannochloropsis_gaditana
atcggtttcatcgagtcctaccgcgacccattcggggtgcgggcggagtgggagggtttcgtggcggtcgttaaccggtccatgagcgagaagttcgccgacctggtccaggcggccgagagcctgctgcccctgctcccctggccccccagcttcgagaaggacgccttcctccgcccggacttcacctccttggacgtgctcgccttcgggagcagcggcatcccggccggcatcaacatccccaactacgacgacatccgccaggacgagggcttcaagaacgtctccctgggcaacggtacgcgagcgatgaccgagagcgggcagcaggggtggtacggcctctctcttgcggaagagaggctccgcttgtaggctctctgcgtggctgggtctgcccaaagggtcctgggggtgcgcctgcggcccccctgatctgcccccgcccacttatccccctttcccgcccctatccacagtcctggccgcctccctctccaccaagacggtcaacttcttgcgcagcgacaatggagatgaggccctcttcaaggccctggtcaaggaggccttcgaggtccaggtcgggatccacgagctcctcggccacggctccgggaagctcttctgccagcacaaggacggcagcttcaacttcgagcgagaaagcaccctcgaccccctcacggacaggccc

SEQ ID NO: 7017 - DNA, 700 bp, Nannochloropsis_gaditana
ttttgaccgctgcgaccgcctattcctctcacaaagccttgatcgaagagctgtgggagaccgtgcgggaagtgctgtactccaccgcccccgtcaaggagctcggcttcccaccctccgggagcagctcctactactcggcaaacgtgagtaaggacgatgccgccgccgtgcaaacgtttctggatgagcggggtatatcagcctacaacacacgcctcttcaaagaggttgaggggggctaccttgtcaggcaggccgcggccgaggcgagcccctcgcccgtggcggaggggactgtggggggtgacgggggaggccaggcccccatcaaggtggtggccggagactttgcgcccctcatgggtcgcgtggcggcggcgctggagcgcgccaaggcccatgccgcgagccctctccaggagcgcatgcttacgcactactgccagagcttccgcacgggctcgatcgaggcgcacaaggacgggagccgggtctgggtgcaggacaaagggccggccgtggaatcctacatcggtttcatcgagtcctaccgcgacccattcggggtgcgggcggagtgggagggtttcgtggcggtcgttaaccggtccatgagcgagaagttcgccgacctggtccaggcggccgagagcctgctgcccctgctcccctggccccccagcttcgagaaggacgc

SEQ ID NO: 7018 - DNA, 700 bp, Nannochloropsis_gaditana
tgttccaatgctcttacgaggcgcccgtcattttcaccctgttgcaactgacctttagcggcgagaaagacggcggctttgaaagcctgaaggcggcggcaggcgtaggcgaagaggagtggagggccttcctcacctttgcggccgctttcctggccaatatggggaacatgaaaagcttcggggacagcaaaatcatccccgcgatttcagcggaagcattccaccaaattttgaccgctgcgaccgcctattcctctcacaaagccttgatcgaagagctgtgggagaccgtgcgggaagtgctgtactccaccgcccccgtcaaggagctcggcttcccaccctccgggagcagctcctactactcggcaaacgtgagtaaggacgatgccgccgccgtgcaaacgtttctggatgagcggggtatatcagcctacaacacacgcctcttcaaagaggttgaggggggctaccttgtcaggcaggccgcggccgaggcgagcccctcgcccgtggcggaggggactgtggggggtgacgggggaggccaggcccccatcaaggtggtggccggagactttgcgcccctcatgggtcgcgtggcggcggcgctggagcgcgccaaggcccatgccgcgagccctctccaggagcgcatgcttacgcactactgccagagcttccgcacgggctcgat

SEQ ID NO: 7019 - DNA, 700 bp, Nannochloropsis_gaditana
taaagaagatgcattgttggcgcgactgctaaacaatagtagatcctcgaaacatctacatatgacgcaatgcttagatagctgctatcatagaaaactgtgatagcctgtgtggttacttagcgcctcatgggccacgaaatatgtgcttgcacattggatcggagttcaggaacatgttgaaccaaagggtgtttgtgtttgttgttgaataatgtgcaccatttcataaagttatcggattcgagtggcggatcattcccgtgtgtatcgtttaagagctttctctcaagaagtaggtttgtttcaatctctggttatggttttagatcatccgagcgtgtatccggacaggtgcggctctggcgacgattgccggcgacagctgacgcttgcccggccgtccggcccctggcacacgccgccccctgccgtcgcgtgcccgtgcccacctggtcattgaagcgccgcgctccccgtctctttctgccaccttgtcattccacaataatggtatggaattctggtcacatcagcagactccaggattgagcggcggttcaaagcagccatttgatggtcgttgacaagcctggagggatgtctcgtgtggcgtatctgctctcccttcctttctgcactacgatttgcttggcattgttacgccgtgtaagcaaattaattctcacacctactcaca

SEQ ID NO: 7020 - DNA, 700 bp, Nannochloropsis_gaditana
cccttaccttctacttgcccatgtacttggtctgaaatgaaggggggggaacaagagaaaagatcgcgacggctataaatgtactggttcatgaagatcaagtgtatataagaagattatggggacacgtgtgtatcaaaaagaaagaaagtacggttgcgtccaaattgcctccgaagaaaaagacaagaagattttttgtcgtactcttgtgtctttgcggctctctccggcggaaataagtggggatccatgtgagttaagcagaaaatatgtatggttgcggtcttcattgcctccgaatcaaaagactttcatgtcttactcaagtgcctctgcggcctcccctccctccggccttgaagctttcggcgagcgcccaggaggccatctcgcccgcctgttcaaatttcttctaaaaaagacacggggacatcattgcgcgcatgatggaatcgtgcaccatgctgccgacgtcgcagagcggacaattttcccaaacgaacgtcagtttcttctacgcttcacaacttggtgggcagcatgcttttcatccctcggcgatagtgacgagtacttctgcccgcagctgcactctggctttgatgccttgtggtgtctggtgtatgtcttttcgtcgcctttgacggtttccccgcgtcctgattttatgccttttcatacagtataacagaacatg

SEQ ID NO: 7021 - DNA, 700 bp, Nannochloropsis_gaditana
tgcagatggggtcgaatggtgactagagccgtgacttttactcgtcgcagctgtagcagcagcagaatgcgtagcgcagcctagagcacatgaacatgtttgaaaaatgattgatatctgtatttgcgctttgaaaataggataagacataaatgctcaatctctcatcaagttcaaagccttttcaacttttgccttgtggtagaatatgatgcgggggaagtgaaggagtcctggagcatcatttcttcatttgaggctcctggacgatggcagtcatacgattctctccgttgcatgtgtttatatagtacatcgtggaagcccgaagtatgttgcagggttatttgaaggacttgtggtataatatctctcattatttattatattaggatcgggaggttaagctgcggggatagcctgtcagagtgctgtcgagccttaattccaaatagtgtgactatgacgatagaggagctcgttcaggccactttacattcgtgtttctcatgtgctattacaacacctggtgcagcgacgcacggcgtttcccggccaaggaggatcgccaagactgagaggacgagaaggggcaagaggcggcgagcacgcacacgagtccgtacttcaccctgcctccgaaaactaatcgcaggccatatatgtcatacccataggcccaaacgtcaccaaaccaatg

SEQ ID NO: 7022 - DNA, 700 bp, Nannochloropsis_gaditana
atttagctttaagcagcgacctgcacgtgacccgtgcagcatgtgctctatgtcgcccatttgatgttgccgtggcagtacgtggcgagataacgtttccttacattgaataaaagtacaagatgtcgcttacttcagccagtttaattcatgacttctccatttagattgcgttcgatcacgtcggacaccgccgacgcgatccctgggtataaggcgcagctcggtgccgtgcttgatgagaacgttgccagcagactgcgcgggattgatgccgactccgtcatttgtgatcatggcgctcgtctgcgccggaaccctgaactcctcggcaacatactttagcacagcagtgaagggtgcatcttcaggcacagagacaacgcggaaggggagcttcgggtccgaggtgagagtgactttgaaggtcaccttcggggacgcatccaccccactcttgcttctgctgcagctgctgctgttgctgttattgctggccatgctgtttatgttgacccgctcttatcaccaggagatccaatctacttcctgtcaaattggataccgcgtcaattttctcgagtgtaaggcatcaaagcacctcgtgtgagtcgtccctttactcttgaacccgtctgctttcgtttggcttgaaaacttgaccgcggctcgctgtgtcgagatatgaacgcccaagatg

SEQ ID NO: 7023 - DNA, 700 bp, Nannochloropsis_gaditana
aagaatcataccaggcccgcttccaaggtatcagatcaagggattgtgctcgagtaccacgctttttcccagccccacagagcgagaagcggctactgcccggtagcagtgctcgccgccagcggggccgtacgagaacatgttcgcttcaattcctctcctcctacttacataccttcccacgtctctattcacgtgcataaacatccagggggtggagcatggcgtggacttggcagcttgtccaccattctaacagcccacgacgacagcatggcagcagctccccttcacgcagcccccggctgaagccgatgcgcatttttcaagcactcctcgtccaatgcgtcgctttgttcccggattatgccatcgccgggggattgaatagaatgcatggagggatggggattgggctcacagagtatagaaatgtcagacctttggccactatcaaaggcgggagcacggatgtcagaaggcaagaccttgggaccccttcaacccgaccgaaaagaagtccctttggtcttgtcgcaggcacagatttcttcaccattggggcgcgcttccaagaagtggcaagacacgaggttggggtggaggaggaatgggagaaggaggacgagacatctgaaggccggcaggctatgcatgatcgagaggcaggaagagcgtctcaaacgccacggccggccga

SEQ ID NO: 7024 - DNA, 700 bp, Nannochloropsis_gaditana
tcccgcgcctccttgtccaacgcgaattcttccgccatgctggtcaggttcggggcgatcaggttctgggtggcgaacaagcaggccacacccacgcacatgaccccgaggggaagccaagcactgcttattttgtgtttagaagtgctgcggtgggcgggtgacggatgccgaggcggcgacatggtgacttcgaacgaagagaggactttatgcggcatgctcggcgacagcggggcgggttcttccatctgaagggacgttgtgttggctccgggcaaagacgtgccagtaagggcggcaagagaagagggggttgcagccctggaggaggaggccgcggtaggagcggcaggaggggcgagagtggtcgacgtggatgcgcctgacgaggatatgaggcggccccctcgaatagggggaggcatggccacaactgtttagagacatgaaaggacattgacaagtgagaggtagggcagttcatttttttaacagcagcagggcgcgcggctagtttttgtcacagtgggggcaggaggcgcagattatgcctttgacaccgttttttacctgtgcgttgagcccgtgccgccccagcccccgctcacagctcagctagctatgattgcccgtgttactgtgatcatattgtgtcgaaggggactgtaagagcttaaattttgagtgattcgtcatg

SEQ ID NO: 7025 - DNA, 700 bp, Nannochloropsis_gaditana
ttcttcgattatcagttgagccgtcttgaacatggcatcttgttccccgctagtctcctcgtcgccgtcaccgagcttgcttccacgtcttggggatagggccgccggtgggagcaagtgctgctgagggctttcaattttgcctgaactcatcaccacagccaagggaatttcgcgaccttcctcctcctcctgcgccatgccgcagaaaatgtgctattcctgtgaggatagagcgatcagatttgaagaatgccaagtgcattcgtacgccccctgcatgggggttattaagcccaagtcaggtggggctttccgcgcccttttttccgaaattttgaatttgaaaaagctttcggcaccgttataaaagccgcgtccctgtatcctaaacagcctgtatgctacttaatcatgccggacaaaggaccgtgcaagctttcctttggtgtttctgtcaaaatttctccattccttgacaattcgaattccgcacacgcctcgtcgtcggcgggcagatttattttcctgcaggatttcgggatgggccacgccatgcaccgaggaagacgcctcagcactcgccttcaccttagtctcgcctgcagctggatattcatcgtgaaggcagtcatggtagacaatatcatcgatcacgcttcctcgaaaaataacacgggcggcgggcgtcgtttaaatg

SEQ ID NO: 7026 - DNA, 700 bp, Nannochloropsis_gaditana
aaaagtaagaaatgctttcggtgtgctgatgacaggaagatcaggggggccgcggggcagcaatgcattgggtttccggcattgaaagacctcacaggccaaatccagccttcaatcaagttttaagagttttatggcctaattaaattcgcattgagtggtttcaaatacctaattcgtgtgcaatcatcctcgcaaacaggcacgaaagctttaggatgcaacgcacgtccgatgcccctgcttgaccgccgtctgagagcagcaatttttatatcaaccagaccaggttcaaaatgctgaagcaaataacatttaacgctacacaatgattttcactccccaaaactcaagcaaaaggtacaaacaatgtgttacggatggctgtgaaaagaaaagtatctttgggtttgaaagagcggggctcctgggtggcagcgactcttccgaagcaggtcatgctcagccataaatcagccaattttgcatctcgcaggggagtgcagccgtagtggtgtatgaagtgcttacaaacttttatatttttccattacgctgtgcgtgtgaccgccgaaattcgaccaatgacactcaaagagttggcaggggagacaaagctcgtgcttgcccctatctttcctcgggggccgtacattgcttcaacccgctctctcacacattcccatccctcacttctagc

SEQ ID NO: 7027 - DNA, 700 bp, Nannochloropsis_gaditana
  misc_feature (1)..(596): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctccctcccacttcctcctccccggccttgtcgacacccacctccacgcccctcaatttggctacacgggcaccgccacccatttgccgttgctggaatg

SEQ ID NO: 7028 - DNA, 700 bp, Nannochloropsis_gaditana
caaaaagcggcgcagactcgttttgcacctcgcgaagtccgatccccttcccgccgcggccagatctctgcttgcaccgcagcactccttgaataccagcgaccatggcaagtgtatggatgaaaacagtgagagcattgtaatgacggggggaatcgcggagaaacccgtgcacgacctgactctagagagtgacgaggacgacgaggagcaagtggaggttatcgagtccccgcatccccgaggttctggaatcgaaaatggccgcgagactgctgccagcaatccatgtgccgcggaaacacaggcagaactcaagaaaagctggaagaacggggccgaacacgcgaactactccagcagtagcggtgggaaggtgggctcgtcggcaagtctccctctacttcccttctacctgggccaggtccgtggtctctcccctgaatacaacgcgcagtgcctggggttggaggatattttctccggtgcttttcatcgcgccattgtctgcaactacatgtacgaatggtccttcttcctggagaccctgccccgcctcctctccatcccttggctgtgcatctacggagatgaaaacccgagcacgccccagatttccgaagcctttcccaacatcgccaccttcaaacctaggttccgcaacacacccttcgcctggggaacgcaccattccaaaatg

SEQ ID NO: 7029 - DNA, 700 bp, Nannochloropsis_gaditana
ggcgtggtattcctagcaatgaaccctatttatttgaaatcatactcgtaagttaagagctcacagcacccggcaaaaaaggcagggacatgaaaataggtgtgtgggcacgcaaaagcacaacgcagggaacggatattataacgactttttaaaaggaaaaacggaagtaacgtgcggcaacggtccaacggctaagagcggcgggcatgggccttcgttggatacttcttaacaatggcgtcattgacccccgctatcagggtcactacggtgctgcaagggttagtgttgtttggctgggtagtgataaatcccatgtggctcgcttgcttctttggtcttagagctcctctcaccatcgtcacggtctcggggcaaacacgtatacgaggagattcctcttcaaattttctcgtacttcatccacatgatataaacatgcatcatgactaaagccagacttcctttttaacatcgcaacacctcattttcaatttgtgcactgattccgcaaaacttgacagcaaacatcatcacgtgatcctctgagtcagaaccacgtatacctcttatctcctctatccttcagccttcgtctcgtttttcctcctcttcacgctctaccatgaatctatgtcataacatttccttcctgcatccaactcgctcttcgttaatccatttcacaggaagcatg

SEQ ID NO: 7030 - DNA, 700 bp, Nannochloropsis_gaditana
agagagcatgatgtaattttatgaaagactggaaagaaatgaacatgtgagccaggagcaacacgtatgcggtgggagggggcttgtgcttcttttcagactagaaggatagatatagccatttgccgagtccatttagggtgaggacagtcacgaaagggccgatgccatcgtgcctacgaacatgatcgaaccaaaaaggaccttggacaaggccaatggataaaaggacggtatgctatgcacggggcagtttgcctccgactcttcctggaaataacctcctgactgtctcgaaagaaaatttcgtaagttccatgttctgggaaagctggctaggacgaccaagtccacggtcccacgacaacaaattgatagagaatttctgcctccaatttgatggctgtgtcatttacaatttgtggcacgctgagtgcgatttcgtagcttcgtgacggaggtgttgaaagatcaggcgtgatgcacgtttgtgttgcgtcccgacatggtgactaccttttctcaaaattttgttgcttaaaagggaccaaaggatacgttaaacagcgttcatgtggatgaaatgatcaaattcatccattctgatatgtgccccacgatcttgtactatttttgaccacccgattccactcgcacccaccaacattcatgtccctgcctaggtttgccgtttgaaatg

SEQ ID NO: 7031 - DNA, 700 bp, Nannochloropsis_gaditana
cagatttaagatgttggatatgacgtggcatttactatgctttactgcgagcgatgaaaatatatagaagatgaatcgtcgagcagcgaccaaataccctaatgtgcacctcttcttcatgtatcattttcatggattgcaatgccatggaaggcatagtgcttaaaagatggaacagtagtacctctcgaaaatagaattaaagctataacaaaagctttattcctgattatgcctttaacttaggaaaaaggttcatgtgcgcgtgcgattggcaatcgcggaagcaagttgcctgcgtggcccatggcaacattatttagcgcaaagacaggccgtgccgtagaccttaagcttttatttacggcgagattgtttgttttttatcttgtgaacatattcatctccattttcatatcttgtgagtctaaatttaacattttcttaggatacgtgcattatgggttgtaccacgtaccccctcgatctccatgccctcccttgaaggccaggaaccatgctctttcaacaaaaagacaagggccacgagaattgcagaaggagtctggacgtcctctcacgatgctttgaaataaatttacattgcactactctcctcgtttttctccttccgtcctcgtgattaaacagtgtgtttcgtctcgtcggcgcatgagccgtttcttgcaaaagtctcatg

SEQ ID NO: 7032 - DNA, 700 bp, Nannochloropsis_gaditana
agaatacactttcctgacacgtctcgtgaaatttcagacaatatcgagtgctatataagcacaaatattcaaactttgtccagatttcataaaattacctttaatgaatgttctgcaatctcgcgtcccccactaggctcttgctccctgttgacagagagccgttgaaatgggccgacagctgacctgctggcctctgttatctcgcgcccaaagagattcaccgagggttgcctaggctctctccgctctcgcgcgaccagctttttaacaaagtctgcatccggtttcccttaatttggtgacggtcatggggtggaaggattgagatcgtttttttttgcatccagggaacgtcttttcggattaatagaaacatcgactccatgggccgcggaatccagttacatgtctacgtgacttgtgtgcgagctagatttggctgcggcgctgcagccgatgaatctatcgtttttctttatttctactatatttcagaggttgtcattgcttcttggtaaccacgcaaatctctgtgcgggcaaaacgtccaccacggcattcctggttctattcccttccctctctttctttcacaaggtgacttgaacacttattctgattagatagcatcaaaattaaaattattcgctctgtctttttgtccgcttttttgtcttacagttagcttcaaacgatg

SEQ ID NO: 7033 - DNA, 700 bp, Nannochloropsis_gaditana
ggtgagcgcggtcaagaggaggacgaggggaagacattgcacgaggagaaaacgcggaggggaggagacgacgagggcggacggagagggtgatgacattggtgacgagggtaggggcggggaggagggggagggggaggaggaggaaggggacgaggaaggagaggaggaagggagggagggaggggggggcatctggtcttataccggtctcctccacgcacttgatggcacgaccgggtgcgggggctgatattggcataagccctgcacaagtggaggcgcgacgcccactactgaggtgggaggttgaatcggaggaaggcagtgagtgttgagctcggcgtactgacgggcaggcggcttccatttcgacgtgccggttgaccaccttgaagggagtgagatcatcccgccaacaaggtgcaaaaagccacggccaggcgcgcgtgctccgtgtcagcgactcgctgggtgcgccgcaagatgcaccatggtaggtttggccgctgtgggtgcatggccggggcgcgtggtctttgtgtcttaaggcagacgtcctgactacggctcagaggctgcatgccaaggtcgtatactcgctattcgacagcgagaggtgaaggacgcatacgtatcgcttgccgacactcacaagccagaaacttgccgcaagctctttttcacgcgaaaacacatg

SEQ ID NO: 7034 - DNA, 700 bp, Nannochloropsis_gaditana
atcccaggaagcccaaagacatgatcaccgtgcatatgggtgataaaaatcccttgaattttgctcgggttcagaaatgaatgtataaactgccgttgcgtcccttccccgcaatcaaaaagcatttgttttccacccacccgcaaccccacacatggacaaccgctgcgcaccgtaggcatcttcgccgcgcaaccaagtatttggatgtcaaatcccgtgaaattttccgcgtcttgcacgtttattaatcgagatggcgaggaatggaacggagaggtgggaagggagcgtgtggaagagggcaacaggcgcttgcgtgactcccgccctgtcctaagaaaaccccagcatgccaacgttctgcctccggtcgtgcacctaaacataggtctcatgtcctgtgcgatgtatgcgcgttttttatgacgacaagatgatataaatgcgcgcgtccttgagccgaccagaccgttagtcttagccgtgccgataacctcctgcctcctgtccggactctgcaagccccgggcccctaccctcatttttcacataaacgtgagtcttgcactcgctaattggatttatgtgttctaacaccaagtgtacaggaatatccaccatggcgttctccttccgctgccttctgctccacaaattggtcttcatccttctgttgtctactgcaagggcgttcatg

SEQ ID NO: 7035 - DNA, 700 bp, Nannochloropsis_gaditana
  misc_feature (1)..(638): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtagcggttgctcaagtgcgtcaaaaccagccgtcgcgcccgcacgtgccgggcgaagcgg

SEQ ID NO: 7036 - DNA, 700 bp, Nannochloropsis_gaditana
gaagatattgtcggaaatgacgcggacgaagaggatttttttttcacgcagacgcaggaggatggagacgaggtgtgggaatcggatatggaggacgcccgcggccgcaacacttcatccgcctcaccatctgcattgggtgcaaattcagatactgttatacaaagatccgggcatacgaaacattgtctatcaagcgcggaaaagaaagtggtccattctgagcaaaacacttctgccctccctcttcctgacggtgcggatgctgtcatttcccgcacctcaccatcccactcatttcctcgcagtacctctggcccgcagaagacggctagtacatgttatgtggcagcgctggatagcacgaggcatacaaggcatttctacacctttcttggtgacaaggcgggcatggacgagaagaagcgatcgagggaggaggtcgaacgcatcgtgcacgaagcttccaagaacagtaagttctttcttgctcaacaaagaaatgacctcaaggttcaagagcggattcaggtgatgcaatccaagctgaatatgttgtcagagccgctccgtcgtagcctggaggcagaggcggacagagagttggcggcggcggagaaagcgtatcgaacttggcgccaggtctgcgtcgtggtcgacttggacgcattcttcacctccgtggaagagcgggacgagc

SEQ ID NO: 7037 - DNA, 700 bp, Nannochloropsis_gaditana
  misc_feature (493)..(502): n is a, c, g, or t
cgtcattcactttctccactccccaggacgggttgccgcatccgcagtgcactcctatagccttctacaattctgaagctccctatgggagcggtcggctaatcgcagtctccgatgcgtacatatgttacgccatcaaggacggccacatccgagggatcaatcggcagacggtgcagcgcactttactcaagggtcataagaaacccatcattgacatggcattcgcgagccggtctacgtgtatgctcgggtctttgggtggagacggctctttttacctgtggacaatcacggaatcggccgcagacaaaagcttgacgtcggtgccccttttggccgtaacaggagtggatctgcagcgggtcgtctggcatcccaagcaagtacacatgctagccgtggtggctcccaagggagaaattgccttgatcaacacccaaaagcttattcagcagagagggggccgggtcggagatcccgccaaagtagnnnnnnnnnnagcatgtgcatctaactcggcgttgacttcctctcattgctcacctgcgcgaaaaaaatcgcagcttgacaggttgtgcccctggacaaggtcgcgtttgcttctttcatcacgtttggcaaccagggaaaaggcactcagtagtatccttccatttaccgagtgggaccctctcgcacaaggcactgggatacgatg

SEQ ID NO: 7038 - DNA, 700 bp, Nannochloropsis_gaditana
accatgtggaggcctgtctcaaagggccttgtaggttatccgactcgcgggggagtgccccggcccatcatgtcgtgatcgccgtctcgggaggcgctgattccatggcgctgctccatcttctgacccgtattcgcaagcgatgggagccccccttgaagctgacggtggcacacttcaaccacggactgcgcccagaggccgtaaaggaagaagcgttcgtcctagacgcggcggcgaggctgggggtccccgttcacacggcaagctggcaagaagaggagcggtccaagagtgcgggcgttcaggcgcgcgcgcgggaatggcggcgacaggaatgcgagcggctgctccaggaagagagaattagtggacggtggcaaagggggaagggaaaggagggtggggcggtgggcgagcgagaggagaggggggatgggagcgaaaaggaaggggctcagggcgtcatcgccacggctcaccacgcggacgactctctggagacatgggtcctgaagctgctgcgcggcgcgcacatcagccacctacggggcatggagcctcgggcaggcccatacgtcaagccgctgttgcaccttcccaagacccgcctggttcggtttctagaaaaagaaggtctggcatgggaggaagatgcctccaaccagacggagaagtacaagcggaacaaggtgcgcct

SEQ ID NO: 7039 - DNA, 700 bp, Nannochloropsis_gaditana
ttcctcctcttagcgacagagcgcccggtgatcatcatacagcgccagcaaggccaagaagccatgcctgcgggagaagttgtcaagatacaatagaagagcgtgtgcaacttcgttcagactctgaattagcgtaggcaatgttgtccgctgtgttcgctgtaacgcttgcactcgctagcatccctttgatgccttcccccaaaacccgcatgatacgacagggtgtgtatcgtcctaccgaccttcgagtcagctctttaatgcagcggagcgattgattagcaggctgcggtgccccctcccttcgcttttggggtacatgtacacggggagggtgcgtcgtacagataaactatcccatccgcttcagctcctcctcttgctcatgttgcaattctcggccgctcaacgtatatgcccggcagcgggtgcacaagcgacgtcaaccttcgtttcattttcgaagactagacctgaaaactgtctgcagagacctcgcgcttctctgccccgcaagcaagcccttccattgtccgtcacacccgtcacttcccctgtccccgagaacgagacgtcgagctggctacttgaccatgtggaggcctgtctcaaagggccttgtaggttatccgactcgcgggggagtgccccggcccatcatgtcgtgatcgccgtctcgggaggcgctgattccatg

SEQ ID NO: 7040 - DNA, 303 bp, Nannochloropsis_gaditana
ggaccgggagggtaatctcgcctgcctcgcttccccacccacccagcccgaggagactctgcccgcccctcccacccttcttcctgtgttgccgcgttttaggtcagcatgtgcatctaactcggcgttgacttcctctcattgctcacctgcgcgaaaaaaatcgcagcttgacaggttgtgcccctggacaaggtcgcgtttgcttctttcatcacgtttggcaaccagggaaaaggcactcagtagtatccttccatttaccgagtgggaccctctcgcacaaggcactgggatacgatg

SEQ ID NO: 7041 - DNA, 700 bp, Nannochloropsis_gaditana
gatgagcctgagggcgggtagtgggggctgtgggaggcctcgggaccccacggagcccggtatgcctgtcccagagacgtgcgggcgagaggcgcctcgagtggcctgtgcctccttctatgctcatctctatctgctttctctccccttctctgcccgccttcttcacttcttttttccttcccttcaggtacggcgtggtccacctctccacgggggacatcctgagggcggcggtgcgggacgggacgccgctgggcgcggaggcgaagggcttcatggacagaggggagctggtgccggacacggtcatcatcggcgtggtgaaagagaggttggcggctccggattgccaggagaaaggctggttgctcgacggcttcccgcgaaccaaggctcaggcgcaagccctggaaagcctgggggtggctcccagtgccttcgtcctcctgaacgtgccggacgagctgctggtggagcgggtggtgggccgccgcaccgacccggcgacggggaagatctaccacctcaagtacagcccgcccccgcccgaggtgccgagggagcggctggtgcaccggtcggacgacacggaggagaaggtgcaggtccggctgagggccttccatgagcactgcgacgcagtggcggggtgctacaaggacgtgctggtgcaggtggacgggacggccaagaagga

SEQ ID NO: 7042 - DNA, 700 bp, Nannochloropsis_gaditana
ttaaattttaaggggtaagggcgaccccccagtcggaattggcagatcctttctattatattattgttcactgctgctttacttttttcgcgccatattcaacccatttttttcgcgccaaatttggagcggtcttcctactcgagtctcgaggccctcgagtcgaggggggcgaagagagaggcacgagggctaaccacgtgcgaacagctttgtggcgagtacaagaggcttgttaattgcattgcgcgtccagatccacatcctgcgggcacgtgtatgctgcattgttgtttttacctttttcggctcctccggtctgacgtatcagccagccaccatttgtggatgcagtatcccgcctcactcgtctcatcgatcttcctcgatcttgttcctcgccctcgtgcctgcgcgaactttcgagtagtttgatggtcgacaaaacgttatcttctgctcagcacgtatacacacattcatatctacataaaattcttgcagtctccacatcatctgcacacgggatggtcgagcacgccacttcctcccagagggcagtagcgacatgtggagttgtgttcagcctcctcctcctgctgctgcagccacacaagtcagtgagcttacggagtggcggtgatgtgacatctgggaacagcatcaacaagttcaatgtcagacatgcaggcatggcatg

SEQ ID NO: 7043 - DNA, 700 bp, Nannochloropsis_gaditana
  misc_feature (688)..(697): n is a, c, g, or t
ggggttgggcaggcgcgtccagcgggccttgtctggaaggggaggggatagggttagggtcaaatttagggttagggttagggttagggtgagaaagaagcgggcgcaagaggggaagcagagcgcattgacggggaggagggtggacaacaaaccattgagaagacgcaaggcgctgtgggagtggtgcttgtgttttttggaagaggggggagcagggggcaggaggctgtaggcggcctttggaggggggctggtgtaaggcgcgaaggggagtcccagtgaggacgagggcgagggcggtgtcgaggtcgggagagaggagccggtccgacgcagaagagtcaggccgggcgaagacgagctctgacggcccattacctggaagaagaagcgcctcctgcggctttctcccccgccccgaccttccccccggcctccccctccttccgccgggagggctgggcgcaggccgtgtccctccggcccgacctccttccctgcctcccccggcacctctacggttcctgcgtgctgcgcgtgctgctcgagttgctgtcgctgcaggtgccaggccgcagcgccgagtgcgaacaccttcagagcctccaaccccacccagcccccgcccagccccactgtcagcgagtgcagggcctcccgccaggatgcggcggtggctaaaggnnnnnnnnnncgc

SEQ ID NO: 7044 - DNA, 700 bp, Nannochloropsis_gaditana
gccgagccagtgactgaaaaaccacgacatagctcgcagcaaggatctgaatctaggaaaattgtgtctataggaaacgacatcagtcgtgtcagtggcgcatacctctccttccctcctcgtgaccgtcaaggcggagggcgtcctgggagcttctcttggtaatatgcaagcacgacgagaacagtcgttaccagttgtcggccccaaaaagccgccgtttcggcgcttttgacatgcgatgtgacatattggtcagctcaaagtcatctcaatacgggtttgaccatggcaatcaaaaaaggcagcacggcagctccgagatgaagtgagaaaaagggagagagacagctctccgaaagcgatgggcaataaaaacgtagtcccaagtaaagtaggcatacattaatgtttgtcagcagaggaacgaatcatacgaaattagactttacgtcatcgaattgccattctctctcctggaaaagaagtttttatgtcgtaatggacgcgtgcgtggcttcatggcactaacgacgcgagcgttgatctccgcgctcgacgggacatgaccacgttagccacttccaagcacatccacgcaaccttgtgtaattggatgcaaaagcattatcatacgcgagaatgtgggaatcacataacattgcgtacatgtcacaggcgcgcagagtgctactacatg

SEQ ID NO: 7045 - DNA, 700 bp, Nannochloropsis_gaditana
ggacgggtcgaacgagaagggtctcctcccttcttaccgcgtgtacataaggaactgcgaatgggtagctggagacctttgacgctcaagttctggtaaaatataaatgactgcttttatagtttttccttctcaaaagtgctacagaccggtcaggtcacaaccaagcatggcttcatttaaacactgtccgtccttacattactttcaaaatgcggtccaatttcctagttaagcacttttcgttcgaatgctcgaatttgtggaaggcgatgcccgtgcgcaaagcgcttgaagggggggaggtgaacccaagttacgtggcttgtatgtgcatacaccagcaccagaatccgtctgcctgcatgaagttgtctcggcgacactcctgcactgtgtgtggacgccggtagagcaaggattcggtgattgtgccgtgcgcgactgatttgttcccccggcccgaagaggagaggagcgagcacgacgagggcaggcggcaaaacggttttggaatcaccctctccgcttctcgtgccctttgatcacgttgacacatcgaaggctgcccaagtagacttggcatcacacgcattactattcttgagtcaaattcaagctcacctgtcgctcgcaatctttttttccttccttcccaccccacccaaatgggaaaacccaagggccctctgtcaacatg

SEQ ID NO: 7046 - DNA, 700 bp, Nannochloropsis_gaditana
gagaaggatcgtgcgaacagttttgttggaaattgtggggtcgaaggaacaattttgacatgtgcatatatacgaacatctttgtaattcgatcgatcggccaagcctgtggagtggcgctgaatagaaaattgccgagaaggagacttccatgcctattgaattgtatgaggctcgtcaattgttcttccggaaacggtcctccgtaccattctatcagttgtactttgtctccacctggctcaatcgcgtgaaattccatctcaccaccaagacatgcagaagtcaggcccagagaaatagactgatgcaacttgaaatttaacctctcctcgtccacgaacctcttaccgtcggcaaccgtgggctttctcctaatcaagtagtaaaggccgcatgccgggaccgcggggggcggtttcctcatacccggagtttctttctcccttgcgcagagcacagacggcatgaaaaggattctaagtcggacacacgacgacactcataccccaaccctgtggtatgccgtggcgacgtaccgtgccggttgccatgttctttggaaacatcttattcgtcattttgtattccttcgactaggttgagatatcgtcttgggccctggcgtgccccaggctcgttcctcgtgagacgagataagagttcggggcaaaggaggccgttccatcgccctgggatg

SEQ ID NO: 7047 - DNA, 700 bp, Nannochloropsis_gaditana
cttttaagacgctgtccctcaggtattgtaaagtacatttcggcctctgtaccactgtgcacaacaatttgtgaaccagagcgcacgaaagacgagaaagaaattgtgtggtgaccagaaaaagtcctaggaggtacgttagagcaaggggatgtagtgagtgcgaggcatttttaacaggacaaaaccacgcattaatgctataggatagcacgatcttctgcattgaaaatactttttcggtaaaattgattcgtattatctaacgatgcacaatgtgctggccaaaaccttggtcgtgcatcgaaagcagcagggaacctcgaatgctccactgtttttcccatgagcctcttctcctagtactgtgattcaacgagggatgatcttctccttgtactgtgattaaaggagggatgatctccttgtactgtgattaaaggagggatgatcttctccttgtcctgtgattcaacgagggatggtcttctccttgtcctgtgattcaacgagggatgatcttctccttgttctgtgattacaggagggaagaaaagtcacacttcaacaactgacgaagctaagggccactttatccatccagggacttggcattcctttccatcgtccgcaagtcccgggattgggaacctcttatctgctccccttcggccttcatccccacgcgacgcgcaccatg

SEQ ID NO: 7048 - DNA, 700 bp, Nannochloropsis_gaditana
aaaagatgaaagacttctactgagcacgcgtgaatagaggcactgatgtaattcggacatgacagggcgcaaataatgtctgcccctgactttcggcgacggacgtcacactaccgacggctcaacttaatccctcgtcaattaacatttcggtagacgtacagggcaagaacgatggcgttcatgtttctatctttactgattgatattctaagagatttaatccactttccctgtcatatttgatgccttgtaaagcgggttcaacctgcacgcgaggacagtatccagagcgtctctccgtccccctggtactccccttttcttttaaccaaagccttttcaaatttccaattcccagtcatactttatttagaccttaattgctgtgaagtgggagtctgcttttcaagctccacagccgggcgctaaatttcaagaaaagaagcttgcgttcaagaagatcatgaggctggctgtagggctcctgtcggtggttgtcgccatggccagcgttcttagcagcgcccatccaatttgttgtacggtgaataaagtgagaaaattacctagcacaccggctgtaacgctcgcatccttgcaaggggggcgaatcttgagaccagacagaaggagccatcgacacatgccatggtccgcgccgtacgcgccccgtggcatgctgagcagaagggccatg

SEQ ID NO: 7049 - DNA, 700 bp, Nannochloropsis_gaditana
cggcctcatcctcaatccttacctcgtcctcttctaccaaccctccagtatcagtcaccaccattgaaattcctgcataggaacacggccccgtttttcgatcccgtgttgtgccaggaatgggagtgacaatggcggttcctccagtccatcgccctttggcggtacccgtgagacgattaaatagcgtggatttacccacattcggtctcccaatcaaggcaactcgaaacggacgtgttgaagtctcatcgttcgaggcatggacgtgcgtgtgcatggactgggagcactttttttgccacgaatgggtccaggcaagggaggggtggggaggtaacgctgacaggcagcacatgccggggcgacgcaggacggtgcaatttgcagcaattaaaaatcgcgtcgacggtggacgccgccaccacatggcacccagtccgaatattcctctctccctgaggttgggcatggaggaaaatatacatgaaagtggcgaaaaatacagtatcatagcccgggtgcttgctaggttgcacgacctgttccgtcctccttgtcgagcctcccctccccttaatgagtcatcccatccatgtttcgagtcacaagccacctcccgtgcatgttgttcaattatcacaggcacacatcacatagctatcgcaattgtaccgagccgtgcggcctgacgctcatg

SEQ ID NO: 7050 - DNA, 700 bp, Nannochloropsis_gaditana
tgtcgacattgtccgtgtcctcgtcaggcgaggcccccgggccgggaggtgcccggggtaagtgctccaaggcggcattcaccaaactggatttccccgcgttcggcaacccgacaaaggccaccgtgaccacctcttccttttccccctcgcgcccacccggtgcatccttctcatgatgtcttcccgcgtctatgccgggagcattggcaccctgcagccctgccgaaagcgctttctccaccagcaaggtagccagctctgagataccttcattgtgcgccgccgaaatcgccacagggtctcccagcccgaacgcgtaggcgtcgtacacggcggtttgcatgtctgacgacacccctccttcgaccttatttgccaccaggatggtctttcccgatgcccccaccttgtgcagccacccggccacgtgagcctcgccggcacctacccccgcacgcgcgtccaccaggaaaaggaccgcgtcgctctctttcacggcctgggctacctgggcattgatcagttcctggatttgcttccgttgggctcggaccctctctctgaccaggccgcgcgggtccatgtcctcgacttcttcaccctcaacgtccccggcctcatcctcaatccttacctcgtcctcttctaccaaccctccagtatcagtcaccaccattgaaattcctgcataggaaca

SEQ ID NO: 7051 - DNA, 700 bp, Nannochloropsis_gaditana
  misc_feature (615)..(624): n is a, c, g, or t
tcatggacctaatgtccactacttcggacgaaggaatcagaaataaggtagtagagtgctgctcccaccttctcaagcgtctccgagcagacaacaaattgcaagttccatgcgacgtcctgctcgaaaaagctcgttcacccgtcaatggagcattcacaaaaaattttgcattagtattcttggagatagggtgccctcgcttgcctgctgaagccaaaaatgctttaggctgggccttgttggtgggcttggcggcagagggcacggcagatgaagcgaagcccttcgggagacaccaagtggcattggtacactgcttcttggagacggtggccttcctaaggccgggaactggggcctcattcaccgccacgcaagcctcagcgtcttccatgacggctccctcgtcggggaccaggtcgcccgtcagggaggacgctggccagactccgcttgggagccgcgtgtccgaatgcaccctgccccacccatccgctcaagacatggccttcctccgcgagctcttcctcgacatcctccttgtccccaacgcctcccgcctcctcccctccgcccccgacagcgccccctccgtgccccctccggggcttnnnnnnnnnntcgaatctcatcccacccctccctctggagtccaggctcgccatccggaaatccacaagtcacgctggcattgatg

SEQ ID NO: 7052 - DNA, 700 bp, Nannochloropsis_gaditana
tggttggtcaaccgcgaccggagatcaacggccaggtcgaagtcagtgaactttcgtaaagggggagggtaacaaacacggtgtcgggcacaagcccgttggttgtagaggcggtacagggtgccaggttctcgaaatgccgcgccccgcccgcatgacccagacgtggcacatgggtttgtccaacgtgcctcccccgtccctccttccccaacgtcctgtgtttccgccagagccatccacggccatcgtttctcacaaaatagtttccagatttcgttctgtttcgccatcgcgttccagcttcttgagacctcgagggttcctttgaccacgtccaccagcggtaaaaaagccagaacatgtatccaaaggtcctcattcaaaagtgattttgtcacgtgaggagagacgacgatttcttgatcggagtgcacacttgcgggcgtgatggtggagtcttcattttgccccctttctgttgctgttgccgttgttcctgccgctgacgccggaaatcccgctgcgggcgtagtttctgacaagcggctgtcctcgcgcggtatcgactttccactcgaaaaaccagaagacatgcataaagctgagtgtggaacaaattctgtgaatgcgagcatgtgaaagggtgcatgcgtgtcaagaacagatgggcgaggagcatgcaagcatgacgcaggag

SEQ ID NO: 7053 - DNA, 700 bp, Nannochloropsis_gaditana
ttgcctatctctttgggtcattctcgtagctgtggtctgccacttacttacctgaaccttggtgtagccctgtcggcccaaagcagctttgggaaacatgcaacaggcaacggccttgcgacttgaagctgcagcagtgcgtagaagcatgtttgtgctgtgggtctaccttcatgagatacaatgataacgatgcgagattagagtaagcgacaaaggcggagttttgcttcacctgctagcagcggagtgcaagcaagaatcagggagggcaagcgcggcgtgggcgagcacggagaccgaggccgaaaggacggtgagggaagatggggtcctattccatcacacaccccgtcatcttccgcgtcgtacagtccatcgtcatcgcagacagggtcctatcccatcaccttctgtcgtccgtcgatcatcgggcgaagcaggactacgcaacaaagaaaaatgtcacatgcaaaaccccgcagggctgttatttctgtgaaaaagcaccacagaggtaaaaaaacagtgcactgaattactcttcatgcgtcaaattttgcttgtcggactcctacgcctctactgcttcaaagccttcatcgaattcctccagcgttcctctttcgccaagtttcatttccctgtctgatgatcagcactcatttcttactataacgtacagtttttggaaactatg

SEQ ID NO: 7054 - DNA, 700 bp, Nannochloropsis_gaditana
caccgcgtcacccacttactgcctgtttgctaccgtcaaactccgccacgcccgcccaccgatgccgtcgctgctgctgccagtgcactaggagagaacggtgctcccgatcgcccgctgctgcacatggtccagagaaggccgtcgtgatagcggcacgggcactgaccgcaaaggtgtaggccgtaagccgtacggcgtctcgattccaggagagcatggggcggacaaagcgcgacatcatggctcccgagaagaccctggaaatgacgcgcatcacacgatggacgagggagtgagaccgcattggaggtaacggacacagtttccgagcgtatcccacgtttccgacgacccccatcaagacttcgaggcgatgatcggtcgctctcacgggccgttgctcaggaggcacaatgcgaccgcaacaaaagcgcgattttccgagctattgtcacttttaatctcagcagtgtactgcttgtaggacttctctcaaattgcaaccttcctccatgctacagcagtgcactacgctggggcgaagacaaaggacccgtggtgcttggagctcccgttggaaagcgtaataagttccgtaattgccttatttttcttgcgggtaaaagaggcagcaagggcaaggatcctgtattaaacagatatccctccacaaggcgttcgacatcccggtgacatg

SEQ ID NO: 7055 - DNA, 700 bp, Nannochloropsis_gaditana
cgttgcaggcgcgaaagcggggaagctgctctctaaaagaaggactgaggacccctcctctgttcctgtcttggcgaggaagccgtaatgccgccgaccatccccatctgtgaccacaatcacgtgcatcggagggcgtcgcaacggaagagcattgggtaggaaggaaagaaacgcatccaaagtagcttgacgttgcgtagcgcgcccggaaggaggaagaaaggcgcatacttcataaaacgaggaggaggcagccgaggcggggactaagagggcgccccaattaaaaaggttcgtcgctgccgcccattcagcacgttgtacggtttccacgtcaatgagatggctgcacagcatttctcccggtttctctgctattatgatacccaaaatgagacgagtcgcggcgtgagatatgcagcgggaagggagaggacatgggccgatcggttattcccccgctgccggcgccatcgacaccgtgatgtgactcacaacctcacggaggcggcctgcgcaccacctccagccttggttcggcgcatgcattccattgtgcttcctgacgagatttctgggggactttctcgggcgcttttcatgaagaggccctcattagttcatttgtcttatttttcgtcccgtcagccagcttcgacacaggcacctcctccgctcctttcacgctcccaatatg

SEQ ID NO: 7056 - DNA, 700 bp, Nannochloropsis_gaditana
agccttttcacccctgttgcatgacctgcttccctctttcgtatacctcgatttcctttatcctgtctacaatccccatagtgctgagtatgcgcccacttgcctatatttgagatgatacatgccagtgttaaacgtctaaagcgcgaagttccctcaaaactgcagataagaaactgtagtacaagtggagccctcgcaatgcaaaaggcactatatgatacgtctgaccaacagcaaccccgcatttggtttcaaatttgtcaatcgaaatgcatgcatcactttcggtcgaacatgaatgtagccccttaaatcaggtgactgggcaccatcatgactcccaaagccgtgctcgtgtctgaccatcgtgcctcctcgtcaatgataaaaaaggggcatggaactcaccgatacgtgcagtagaccgaaacaaagacgcgccttgcaatacctgtgaatggaatgcgaaaagttgcgaaggatttctgtaattcatcgttgcgggcggcgcctctggtagagaggagcatttgctactagcttactttgtaagactcgctgaaggccagctagacgcaagcatgtcatattcggggggtgcatgagacaccgggaaaagcacttttcacgaatacatgacctgcaccatcccactgacagatacgactccgtgtgcattcccacgtcaaccaatatg

SEQ ID NO: 7057 - DNA, 700 bp, Nannochloropsis_gaditana; identical to SEQ ID NO: 4687

SEQ ID NO: 7058 - DNA, 700 bp, Nannochloropsis_gaditana
aggcacaaaatgatctaccatccacattataatgtcgcatccctctgaaaagtgctcgtccgtcattgcatcggccctccgcgccattgagcatgcctctccgaggcccgtgccggggttcgatatgtatacaattaccgcgaaaccgaatattctacacgtttcccctttatcaggcttttctcgctaagatctgtgcgatgacaccatagttactaagctgtgatcgacattttcaaagttatttgtcgtgtggcaaccgtgctgagcaactatgctgaaacgacgcctccctcgaatcccgccgaagatacccagcagctagtgctggaaaagatcgagacgcactcgcgacacaatacaagattaggagtggttggcggcaacaatagttttcgatagtttgcaggtgatattttctctctttattccttctgaagtgcaaatgtgtccgctgaagccaaaaattcagagcccttggaagtttacggctgggcaaagtacttcgcttacgatctgcctttctccacctgctgcgaacgattgatcacagatacatgacagcagcacggcggagtgcgctccgtcttaatgctctccaacactcttacgggatgccaagacgacgactgccagcctgggaatctgtgcgatgcctttttgccagcagtaagttttaaatacttgtaacatcaacatg

SEQ ID NO: 7059 - DNA, 700 bp, Nannochloropsis_gaditana
ttgaggggtcaaccttgcttggaaaatgagagcatattcgtctagtgacagatgttctttctcatcttttcaaaaactttggccgctttcgacctactatgtacataaacaaattaagaaatcattcttggaaagatatcaatacgtgattattcactgtgattgtactgtatatcttttggtaaatatgctgctacatgtgtgcatgtcattcatgaatagagttttttgatgttgaaatacaatatccatgcccaacagactagttcgcttaagactgtggatgataagcattaaagtactacaaatgctagcaagcgccattagaattatgcagcacatgttgacaaaaaaaaatggcgacattagccactagtgctaccgcgtttcttatagaaaaacagcgaacacgcacatggaaatgatttgaaatttgaactgtcttctcggccggacatatacatgtgcatgtgtatataacatgccagcgcctcgcagatgcatccgtcagttctctgcggccagacgctggtaatttgtgaaatgatgttaggccaccatcctggggtccacgttcccgtgcacaagaaaggctttcttcgggcagagtctcgccaagccttccttggatgcattccaatctggacaccaaattaacaaacaatgcttgcacccagcgactgaccgttctgttcccatg

SEQ ID NO: 7060 - DNA, 700 bp, Nannochloropsis_gaditana
cgacttcttgagatcgtttttgtgcgtcgttcacgatcgttcccctttggttcgagttttgttggaggagggcggtgatgcttttgtcgatgacaggctcaagtgagcgcaaataagtcaatgtctcgctttctggccgacgtggccgggaataagcgtgaagagttgctccaccttcaccaaatgtgcttccatcgccttgtatttgctgatcttgggttgtggaggatggctccatggaccaagcggtgacggcacggcaagaggaagatactaggtggctttccggtaaagaaacccctgtgaaggcgtgctattcgacataaagcgcccaggactggacaatatgagcatacgtacatgtgaatgggaaatgccgccaccgatgtgggtatgtaaggtgtctctacaggttgggtttggggagtggtggggtggggaggtcaacaatgatgggccacgaccattgcctgccctccaacacccgaggccccccaagccgtgcacgcggacacactcgcaagcaagctatgaatcgcgtccttacatttatttccttgaatcccctagttcagtgatgggccggggaatgcgcggtggtgcaaataaaggagcaaagaagggtaaaaagggcaaaggcaccaaaaagagccggaaggacaaaggctggacgcatgaaggagcaagctttcaagatatg

SEQ ID NO: 7061 - DNA, 5 bp, Nannochloropsis_gaditana
tcgcc

SEQ ID NO: 7062 - DNA, 700 bp, Nannochloropsis_gaditana
ctttccattataccacgagctactagaagcagcgtgaagtcggtcgaaaaaggacaaaagaactgtactgcaaaatgttcgagtctctcgtctccaatggatcagacatcataacgaatgcttgtgagcggtgtgtgcatgtcacttgccggtgtgaaagcgtgaaaagggacggcgtgacatcacaggccatcaagatactcccctctgaaagcccattgcgcttatgaacgggcgtctgttttgcggtcaaaccgtatgacggggaagtattttgcaagtgaggttcatcaaggttaggtcgacgttgatttggaatgtttgaaggccacgcagagtcaattgtttccttattcacggccccttctcgtgctgactcggcctcctccctgacgcaagagggccgccagcgtgcctgtacctttttaacctcttttctccttgtgtcttcgctcttatttattttgaacgcattcattactgtcctcttactattttcaaaattgaaagcctgtggtcgacgttcagaaagtggtgcttttccgtccctcgagtccatcctgcatgtgaactaatccgttgtgcatcgcttgcatactgcttttgtgcaccatgttttccttgcgatgcctcagtcccatagaattttctcccgttcaacttgtgcaaaacagggcgatattcagattttgtagcgatg

SEQ ID NO: 7063 - DNA, 140 bp, Nannochloropsis_gaditana
ggtacacatgtcctggcgagatccgatgcccgtgaggtggccttgcgtggctctgatgtcctcattccccgtgtcgttcttgcctcccttcccccctcttcccccctcgctccttccttaggtgggtagactcgctgatg

SEQ ID NO: 7064 - DNA, 700 bp, Nannochloropsis_gaditana
caatgagaagccctttcatccccggctgcgcacgatttttcaattcaataacattgatgggcagttgccaggtcaagtgaaagtgttgaagggttctggcgatgacgtaccagccatccctctcctccaagcgtgtgccccgcccgtcgtcccgcctcgaccaccccgcggtcagccaggcaaaataggaggggccactctcatacatgccacggtactttcaggctgcatggctgcgatatcatgttggccggggtatgtacttcggcctacgtgcggacatactgtctcgtttggcagggtccctccggggcactactgtggcttctgcgccttgccccagcctttatcgcggggcgctagccctggcactttccacattaatacattggaggagactgcggctagatgtgaatcatgcctatgtattttatttcgtgacaaacgttatttcctctcttggcaaggttttacaaggatggtgtctcctagtgtgtcaccaggcggatactttggaaggacccctaaactggacgtccgaagcgttctgtcccctcccccgctcgataaagagctaactatcaccttgcgttacccactcgaagaagtagaagttacggacaaaatttgcattgcttcaagacgcgactgactttccatccctcacgctatccggcctcttcccctccaactcttgcag

SEQ ID NO: 7065 - DNA, 700 bp, Nannochloropsis_gaditana
ggccctcaagtgctccgcatggacaacaggaggaagtatctgatctgccgcaacccctgtttgttaagtgcatgatgagtggggcaaaaaaaggacccaaccatcaggccgaaagaaagtagactctgaaaataccttttataagagcattgtctgagtgtcttccgcagctcgtacttttatcaaccagtagcgccgctcacgcccccacttccctcgataagcagcaagacgacgtctgtcggcgaaaaagcatttcctacgggctcgacctgaataacacgaccatggaggccaggaaggcaacgaccgtgatgacgtcgttacgaagaatgattttagatgatctttccatgcagcaagcgtttttgttttctttgtcgtaaagctggtgtgtgcatttaatgaaagaaaagtgagggggggacgaaaagagcgttccctctcagcgatgatctcccacgtgctagtcaacaagataacattccctactccttcactgctcgaccatggcagatatacagttacccaacaccgcccaggcattcgtgaggtagcaaatccgtgtggtggtgagtcgcgtttgttggggggattaaattggatctcttcccgccctgctctcgacgaaccagtattttcttcctcatgccatacttgattttccttcacgcatctgtggattaaatagaacaccatg

SEQ ID NO: 7066 - DNA, 700 bp, Nannochloropsis_gaditana
aaaagcgctgcctagtaaatgcaatgaaaacggagctgctaccggatcaaatggcgtgcaaacagcatcatgccgcccggtggagcttaagatcggtccggggagaaaaaagcccgtttggagaaaaatgtttataattataagtcccgcgaccccccgaatcacccatttcagtgaaaatgcatttccgacggcacgagtaccaaatgtcgacatgtcttgtgcctgtattcgctagtgcctgcccgacaagcatgatggtggcatcttgaaacgaaggacgagggaggaaaggttgctttagtagctagaaggcaggaggttattgctctggtgactaattatgaggacgagactgctgcacgacgcttgagtaggaaagcgataaaccgacaatcacgacatcatttctgatggaaaatgcccggattcgagataagggatgcccacttcaggggtgcgtcgtatattgacccgggggaacggagggtatcagaggagctggcacgtcttgctttcagagatcgctcaacgggcatggtatccgcacgtcccatcgtgaccttactttgcattagttcccgttgattcgcgtcaggacttgcaggacatatgcactcaatatagacctggtaggttaagtatacgtgtggatatttttaaaagttacataactgtccaacaaccgaacatcagcagg

SEQ ID NO: 7067 - DNA, 700 bp, Nannochloropsis_gaditana
cctccatgaaaaaaaaataggtatattcaaggttgagctgatacgcattggtttccttgagcgtatcttgtttgtaacatgccgataaaagctcgcgaccatctagggtgccagcacccacatgcacatatgccgtccacaaagatagatggaaagtaagacagggaaattcttaaccaagagcccttttgctataatatttagtcgtatttaggcgtatttttccagcacatattaatcaatttttcatttttgtcactgattggccaagggaggagataaggcagggtggcaaatggtcgaccctggaaactcggatagtgcaccggaagggaaatccaagaaatggcttctaatcggtgcactactgacaatcaacctcttagcagtctatttcgccattgttgatagcacggacttctgggagaaaggggcgactctgccaggtaacgtcgaggctcttgtggaatttctgctttaagtgccttccaatatcagctaagccatccatagctatgcttaattcttttacgactgtattatataacccaaaccattaaaatgatgctgccgtgccataggctcttctttacagctattccaagcaggtcacaatggtagcgatcaaatacccacgcttcctaacgacgagccactaaatgaagatcgtgaagctcggtctaactcattcctacaaatg

SEQ ID NO: 7068 - DNA, 700 bp, Nannochloropsis_gaditana
tccctgaacgtcgtcggcatgtaggggcatgtattcatgatggccaggtggtgctcctggtggcgttgcaggcgggcccaggacgggtgcgaggaggcggtgggaagggccgagacgcagtcaaattgatggaaagtgacttggtcgggcgcggtggggccgacctggaggaaggctcccttgttcccgtagtggttgcagtaattcggggcgctgaagatggtcacgacgggaggcaggacccgaggaggcagacgggaggccagaggagggcaaggccgttcagggcccgaaggagcgggtggaggagcaatccccctcccaggaatggagggcggggaaggaaaaggtggggccccatctccgcccgcggccgccgcctcgacggaccaggcaaagtgctccgagtaaccttcctcctgcacttgatgggctcggatcaaacacaggagatggttgtcgtccaaaaaccgccggatcgcccggtacccgaaatacaccgagcaaccccgctccccgttcggtcgccactccacggccaggtactcgtcccatgccctggctacctgctccttgtccgttgcttctccattgatgccggggtccactttcttctcgtgccaagggtcggcccacagcaaatcgcagagggaaccactggccccaggttctacgaaacggtcgatccgttgaatttccg

SEQ ID NO: 7069 - DNA, 700 bp, Nannochloropsis_gaditana
acgtggtcttttgtggtcgtacaaaacgtgtcgtccaggtggtgacatgctacgcagtgctcgagcatcctggacagtgacgacgcccgagtcgcgggacgtactaacggaccgggcaaggccactgggatacgtgcctgcgcgtaaagttatctccgcatggtggtggaagcagacttcatcggaagattgtcccgaaataaaaggaaaatcatggatacttttgtgtcaacgaccaagtgtagacatttttgcaccattggatcttcactagtgaagacacttaaacgcagtgccatggtagccaagaggcttgcctgccaaccaggaggctatatttcaacttaacatgatcgtgcttgaagtcttttttcaccttagactaaacatatgtgtctgtgaagctcgaaattcggcgtgtgtgcctttgaagggcatggtttagccagtcgagtcgtcctacggcctaagaaagacacccattccatgatttatgctttcacatagagtgtaatggaagcaccttttccccccacatagcaagaatcttctttcaatgatgtgcgagggaaataatctgtatttcaacgagtagatggcaaaggcgcatcacagctacccaatacaacttgaaaggaggactgtgggtacattctgacttgggaatcagggatacagtccatatctttctgttgcgttt

SEQ ID NO: 7070 - DNA, 700 bp, Nannochloropsis_gaditana
cgcaaaagacgatcgcaggtggtacttccctcctactcgtagtacgagtcaacctccccttcagacgcaagttgcctggctgcctcgtattggaagggcgggcccttacggtcacagattgctgcaacccacgttcagtcgtgtttcgtgaccataaaaactcatacagggtcgcactttcatggtgtcctcgaattattgccgggtttgcgcttgccggcaagcttttccctggttttgcagcttgtccgtttcacggagcatcaccacagaggctgcggtccgtccctcccgaaagcatcgagctacacccccaagtacgcccgaagaaaaagtcgccaaggataccagaagaaggcgggagcgatcagacagcgtgtcggacagcatgctcgaggaccggcgccggcaccttgcacgaatagccgcattggcccgagaggacgaggcggagggccctgacccggagattttgaggcgcattaatgagctgggcttggggcaaaagcagcgagggaaagacacagctcggtatcggcgcgggcctaaggacatgacagcgggcccatcgcagataggagctacgggctttgcgaccttcatggcagcagcgagtgggaggggttcggaggggtggcccttctttaaacatatgctgcccgaggtggcgtttgcagggcattccaactgtgggaagtcc

SEQ ID NO: 7071 - DNA, 197 bp, Nannochloropsis_gaditana
tccctggccccccagtggccggggccaggtaccgagtcggcgtccattccaaggttcgctccccttcgccctccccctctccctccctcggcccctccctccctccctgctgcccgcgaacccggaaggcggacacgtctagctcgagtcgccgcgagcgcccttggcccgcgtgcctggcctggacgtgcaccctc

SEQ ID NO: 7072 - DNA, 700 bp, Nannochloropsis_gaditana
cctgttcgatgtcctcctttctttgggggaggggtgccggttgaatcgcgcggccgttttctcttcgtactgctgctgttgttgtctttgctgggttcggttggcgtcggtatggctttggactgtggtactttgtcttacgacaggttaaagcccgcaaatgctatcttcctgttccccactctgtgcaattatttcgccaacgtgtacctttccacacctcttttatgaaagagacgtgccaatcgaagagaagttgccctcgatgtcactgaagatggcatgtgggtacatttattgaggagagtgagataaagatgccaaatggcaaggtagcgtttcattgattagtccactgagagcgctcccaagagttcgatgttcctgttcacggccctctccgcagcaagtacaacgctgcaacaaatttgcccgctgccgcaaggttgccgccgttcatatccttccttcaaacgacctatatgtcagacatggtgacggtctcctatcatggttagctattttcctcgcgggaagcatctagaagggaaatttcttctcgctgcctctcgcacgagagcgacgacagcagtcgaggactgaaaccagaaaataatgaccgtgctcgaccaaagaaagcttcttcacgcctggcttggacagtaagagtaagtcttctcacaaccttatccattaaata

SEQ ID NO: 7073 - DNA, 700 bp, Nannochloropsis_gaditana
ccaccaatttgcacaaggccgtcccccccactgtgaccgcacgacagtcgacgggccctcgggcaacgcctgagtggaaaatatccgagctgataaccctgtgcccggctcaaatgatctatgtagccttttttccgtcacgaagaaaccgactttggcaacctcaaggcgaggtaaagtaagtctccactcgggtgttaaactttggcttgttgatacgctagccccacgccgtagccagacccaactcttgggccattctccgcacgtgactctgtgcataatgacaaatttgtgctgttttttgcgggctggtgtgcttatggtcgggcaggccgcgttcaagcaagtttttgggcggccctccaggcttgtccccccccttcctactggttgcccgtgggcaaagaccgaggtcccctgactgcatggtctaaataatggcgtaatacgcccagtaatgcctagcacactctacatcgtgtcgatttttgtccgtacgatggattttggcatggaggcttgggagcgtcaaaggggctcagggggcgagattttgagaatccatatcggtgtaatttctttggtgcggatgcgtcccgcgcacgtaccgtgaaacccaagcatttcgacgatcaatcctgaaacatgcttctactctctctactacacatgcatgctcggataggtaggggaaatg

SEQ ID NO: 7074 - DNA, 700 bp, Nannochloropsis_gaditana
  misc_feature (1)..(695): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccca

SEQ ID NO: 7075 - DNA, 700 bp, Nannochloropsis_gaditana
ggagtcgaggggaggaaggttcatgaggcaaagcacaagagagatacaacaggtgacgcatgtcgtggggctacaacctcacgcatcaacgtgtcacacctggactatgataaagtgaaggcacaaccgcgggtgagtcggtgagagcagccgtggcaattgttgccctcagaggccgcctccctggatgacggcgaggatatgatgctttacgacccttcctttaccgccccctgccacaagcccgaaagctaccctgccgcaaaggcacgcctcctccacttttgtccgcgtggatcgacagggtaagaattgcatcgtgctgtgtagagaaaggctgacgactcctttcctttgtttcctggcttttcacacagtgtggcaaggagacgttggagttacgctagttgcacaagcagcatgccttcaatgtggtcaacaccaggtccgagaagaccgaagctcagcatcatcgtcctgggcatattttttcttccgtccgtccagggcttccttcatccacctctccccgccttgcttcaaatttcttatccgctgtctgccggtcgctcctcctcctcctcgggcggtcagcaggctcccaccgaacatgtaaatcaacaaaagcggcgaaaacagccattaggaccagagataggatcccagtcggatgaagagaaaggaaaagcacaagccaatg

SEQ ID NO: 7076 - DNA, 700 bp, Nannochloropsis_gaditana
aatagacaggtgcgacggagaatcaagaaaggcagagaggaacaggaggcactcacccgcttcccgtcagcctcgtctttaaaggtgatgaagccataccgtttactttcgcctgtgtttcggtccttgcaaacctgagaaggtaggagttggacggttgacgaggagaaaaaaggaacgagcgggaagtgggcgaattacgtcgatccaatccctccatgtcctctcctcccacacatgttccttccctgcgtctttcccgaagccgacctgcccctatccctacctgtgcccagactatttctccgcctatcgcgtccttgaaatatttctcgagcccagtgtcgtgcgtttccttggacaagttaccgatgaagagcttaaatccgatcaaagacatgaagaggagataaggaggggatagcggcagaaaacaggtgctgcagatacgcgtagcctaggccgtgcggcaatgtgcttgggatatttgaaggaatgaagagaatttggtggaggaggtggacagatgtaggtgggctacagcgtgcaagcgagaggaaggtggtcagaggcctcgacgttctcccgagggtgagttgagggtaaaaagtggaaaccagagcgcacgcttggctggttggcgggaggaaggtggggagggaacgctatgcttcaggagaaggaatatttcgcggagatg

SEQ ID NO: 7077 - DNA, 700 bp, Nannochloropsis_gaditana
tggatgatgatgacaactgagagggatgtaaaaagagacttgttgcaagaggtcgcatacacatcatctgtttcttcctttacgtcctaacctcatctgacataaagcaatgtttcaatagcagtcgttcttaaggcctgtggttcctttaccttgtgtttttgtctgagttgcgaaagagtacttacgtcgtaactgaaccgtggaagggaatgcaacggaaattgtagacataaataagatctttttgatgcattgcccatgcaagagatttgtcctccttgtcactttaagcgctcaaacaagacccatatttgtctttaacgtctcttcgatgtctccaaggcacattttgtgtcgttaccctcctgacccacctcgaacttggcgacgctcgcctgtccagcgacttgatcccttcagacgccgcgatcggtgccacacgcagcatcaagatccgcaacgcaccgtacaatttttgatatcagggcgtttcagaggaaccaagggaaggaaggacgctccttggtgtcgcacggggaagccaggcatgcgccgacctcccccgtatccaagcagcaccgtgtccttgtccttgatcttcaagttcctccgtctcgatgccccttcccgcgcagttgcctcaaaacctgactctcccccatcctacatttcgatgtactcgatagttgcagacatg

SEQ ID NO: 7078 - DNA, 700 bp, Nannochloropsis_gaditana
  misc_feature (267)..(276): n is a, c, g, or t
agtgggcatgacggccgcctgtaggagatgctgaggttacgcaagcgtcagattcatccccttcgttaccgtacccgatgtgagagaggcgaggaggacgggcaggacgccgagcgtgaaggtggtcgggtcgtaggagggagaggaggcgggggaggcggagggccagttcaggatgatggctgaaaggatggtatttagagagagattgagtatcaaagacagagggccaaccctgtatcgggcatgatgcatacagatgacatnnnnnnnnnntcagcctttctcccccccggccctggcttgttcgcactctgcaggcagcaaggtatacgcagacaaacacaaggagaggaccttgcggctggcgtcggagtgggacgaggaggtgttcgtctcggaaatggagggcacgcacgtgcgcatgtcgtggctggggaggctgcggccggagaagatggggccacgggcaggagcgaggcggatgggacaagagaggggcgtggaggggaggaaggaggggagagaaggggaggaggggaaagatgtgggaggaaatgaggagcacagtggatgggagatggatcgggcgaacgaggagagtgaggaaggaaaggagaaggaggggagagaggaaggcgtgggggaagggaagacagaggtgggagagaagggggacgacgagggaggatgggagatg

SEQ ID NO: 7079 - DNA, 700 bp, Nannochloropsis_gaditana
  misc_feature (315)..(324): n is a, c, g, or t
agaggacgtaggtcacgttcctccatgcatcaatgtactgaattctccgactgtacgtttccatcactgcccccaccacgtccacaggtgtcagtaagctggtaatgtcttcctggctatctttggggcggcggacgccggaaaccggcgctgaggagaaaaaggtggaagggtccgggggggggctcgaggctggagggggaggcgagaaccccatagacccagacgaggtgcgacgtcgacggttggagcgtctccaagcggcggcagaagcatctcggctggaaaaagagaaggaagaggccgagaccgcgnnnnnnnnnnctccccccatttgcgcgccaaaatcggcgatttgctctacttggtcttcctcccccccgaggagcggctcgaccactcgagcacctccgccgccgccacccgaggccacagcgtctacacctccttcctcctcaacaaccccttggcccaggcatccctcgcgcccgccctcctcctcctttatggggacgtggagcacacgggcttctatgacaagctcgagcatcgcttccacatcgctgccgtcttgaagttcctctggagatctcccgaacaccggcggaccttccgaaggatctcctccgacacctctcaattcacctccttcgccaacggcttgatgaacgaaaccaacgctctggttgcctccgtgatg

SEQ ID NO: 7080 - DNA, 25 bp, Nannochloropsis_gaditana
cccccccccctgtccccggcccatg

SEQ ID NO: 7081 - DNA, 700 bp, Nannochloropsis_gaditana
ctccacgcctttttctttcacctgacaatgaagatttataacaaatggaccgcggtaatataacatattctttcatctgtaactttaagccactctccttagccttcgacatcacagctttcaagacggtccgaatacctatgcgccctcctctgtcatataacaccattatgtgctggggaacgcacagtcgtcttgaaatgtgcttcttctccacggaaaaggagggaaaaaggccaaaaagaattttttttcatttgggaaaaacaaagacagctgacgcgctcccggtcacatgccagcattccagagccctcgacgtccctaatcatgtcctcaaagcccattcgtggtcttggcaagcacgtgactctctctgacactctttttcttgtcctgtttatccctgtttgtgcgcctgtgtggcaatcggtgggttgaccaggtactttgagggcggtcccacgagatctcaagatctcgccttcggatttttcgtgccacagcctctgggacgaccattcctatatccctcccctcttccgcagctatctcttacgctttctgtcgcgccattcaacaccaacgagcaagcacagatgccctctctcctcctctggctcttcatccttttggtcctccttcctgccgtcttcctccttctactcatcaagcttcccaaacccgtcccagctcgatg

SEQ ID NO: 7082 - DNA, 23 bp, Nannochloropsis_gaditana
tcccctccctccctccttccctc

SEQ ID NO: 7083 - DNA, 700 bp, Nannochloropsis_gaditana
aggagagggatcacgaggaaagtgaagggcgagaggaagcgggcgcgaacgtcaggcgtgagtttccggtcctgggactagacctgggatcttcgcaggcatgcgtggctttcgtggctgcgaaagaacgagcgccagaggtggtggagaatcatgaaggccgacggtctactcctgcgttcatatcctatgaagatgatcacctggtggtaggacagctggctcgccgagcacgatggagggagcccgcgaaggtgggcttcaacatccagcgcctgctgggcctggccgcttacgaggacaaagtccggcctttgttccccttcgccgtcgacgccagggaaggatctgcggacggggacctctctccgttggtcatgaggctcaagggggggcgagccctgacgcccctggaagcgagcgcgcgggtccttgaggagctcgtgcagtccgcggagcacaaactgcacaccaccccgggtttcgccatcctcgcagtcccctcctacttcgatgaaggggcgaagcgtcgggcgctgaaggcggccgccgatgcgacgggtctgagcggtggggcggacgaggggcagggcgggggcctggcggtggtggaggacgcggtggcagccctggtctgcgcccactactcgggggccgtctcggacgaagaggccttcttcgggaagccctggctggtgct

SEQ ID NO: 7084 - DNA, 700 bp, Nannochloropsis_gaditana
gattggtcacatgagatgctttctccactcggtttgcgagggaaagcgacgatttgaacgtagagtccgtagcagataccagctgagccgctcgtgcttttgcttggttggcagtaattgcggttgcgttcctcgccgtggctgatggagacttcatggtttctaaatactatgtcctgactggaagaaataaaaatatccaggcttaacgagatcgggtgtggtcccttcagaatagtgcattattattcaacggaagaaggagaaaagagatgggccgacgcagaaatgcaacatgcatcagtgcattgattatatattgcaaatgagtttacgtgaccagaaattccgctctcaaaataagtgggactgatctcatcgaacgtacattgctacataaattcatgtggacaagcacgcaaccgcgggggagggatcacggggctgtaaggaatggcgtagagcgacgtcacgctgggccccgggcactcgggataagcaccatctcacgcgggtggccgcgcgcagtggcgcatcctcttggtgcgcactaacgcacgcatccacggtcaagtgcgaacagcttaaaatgcatggcagccattcgtcttccaaggctcgcttaattattgccttataaaattcactcgcacacttcttcacctgagtagcctcgcgagcccaattttcgtgcgaaatg

SEQ ID NO: 7085 - DNA, 700 bp, Nannochloropsis_gaditana
tgctgatgactgtttttccgcaccacaatgtatcgtctaaatcaaaactcacgacgtcgaccccaacggcctcctcagggcccgtgccttccgtggacggagactctcctctggccgcgctcccttgcataaaaagatcttcccaatatttctcttgaagcagaggatcctctgaagggttctcaaacaaagatgtggtgtacaaatcccgcgccggttcccgagagtgaagtgcccgtggccgggtcgagcgactgcggggaggtcggaggaaggccgcgactgagggtacaagtagcacgaagaacgcgaaaaggggaaggcagggtgcgctccgggtcatggacaatcacagctctctctgtgtcatgagatgtacgcgatcaaggctttcattgagctttacgggggtttagcttcagtgcagccaccagggccgtcgccgcgatcatcaacgttcctcgcggggagtgcatgggcctgcctcgcccatctcagactctggtaactaggtagacatgccgcgcggcgtaagcaagtcgtatgtttattattgtaaagctccacgccagctctggtctttgcattgcatgcttcatcgacctcaattcctctggttttaaacaggtgataaagaagatatactccctgagttttcgacttactttgctctttgaagccagcggtgccagcagccatg

SEQ ID NO: 7086 - DNA, 700 bp, Nannochloropsis_gaditana
tgatttttgaggttgaatcgacccttttcgctacctgttgaggatttgaaacctttcctgttctctcatcaatcattgctttgccccgattttccgcgggatcttcaatacgatcaagcattattctgatttcctcaattattaatctgcacctggtagctctccatcagtccatcgaaatgtcaaatagtgcttaatggtgcttcatcccaaaatgtgtcgtccaccgcccatctaacccttatcaacttgtcgcgagctccgggaggggtcgcatttaaggtacaaactacaaagcctaaacgttacgtcgtccgacccaatcaaggcctgattggacccggcgagcgtttagtcgtcgaaatttggataccgccacatcaaaagacgggagcagtagaagagtacaataattcaggcgggaatcatatgaaagacaagtttaaggtggtctatatgcaaatccaagacgtgaagaatatgcaagtagcggatgtcaagtcgatggaagtggtaagaagtgtgagagctgttgagaaataattccattgccttggttatgctattacatcattcttctagattcagtttggcattcagaggataccagtcttacgcttcataatttaacagacagagcacctacatcatttgtgggagcaagcggatagaaaagggatctttagccataaatttgatg

SEQ ID NO: 7087 - DNA, 700 bp, Nannochloropsis_gaditana
ctgaagtgttgcccgccgggagcaaggtcggcatgcgtcctgaccgccagacttccttcttgcgcaagagcgccctgtctcctgtctcgcaacgattgctggttctatgcagagacatgcgctgctttcgcctgcgggctacgcccatgaaggccttcctggaggagatgctccgccccgaccgagccggctcgccgccagacacgctcttcgccaaggatatgcgtatctcgcgttccgctgcgaaatacggagtcttggcattgatgttgattctgctggtggctgcctcagtgcgctttctgtggcaagaacaggagaagacctcgtgggcccactttctgctcgtggagcccgcctgtctggccatcctcgcccttcccgtagccaggcccgccctgtccctgctggcggaggccctcagcatcgcacgcctactgacagtggtggaggatttgcatctggcgcaatggcagggcaactggggggcgcaaaggaagggagaggcggaagcggacctggagccggagcgacgcatccggctgaagtccgctcgccgtgaccggatgcctgtgaggaggtttatgagatacgctgccgccaccttgcgcgcacgtttgctgcccgtaccgctgttacaaccccctactcggtccgccgcagcacagcatgtgcctgtcacgattacagggggccacca

SEQ ID NO: 7088 - DNA, 700 bp, Nannochloropsis_gaditana
tttgtgtgccagtgctgcgtttgccagacgacggaacttactgagttgaagtgccccttccaccgagactgccccaccccatttcttacctcactcccaaccgacgtgcactcgccctgaacactcgggctgcaggcatgacgcgaagcatggtaagcatttacctgtctgtaataaggcagtggctgtcgattgtaaagccccccaaaagggaataattgttgcatgacgatgcatccctcaaggtgaagagatcccggcgatcaagaacagggaggcaattacccgacggcacatttgctgctttgatcgaagtcactcaacacagtagacacacaaaaatgttccaatcagacgttcggcatgcgtctgcagggataatgatggcaagactccgcccatgacacctgaggcacacgtaacacgggaaggaggggcgccagaagcgagcgaggagacggcatcgcctccacccaggggcctggattggagcactgcccgacagcgcatttgtcaggtgtgcgacgacgccacctcagctgaaatcctcaggctgcggcagggttcattgaatttcatattcgtggctaaggacgcgctgctctctcaaggtgctttgctggggtgtgtcacggtgcttgtgattggcgaggccctggaggagcatagccacgacgacggcggcaatggtgaagtggcc

SEQ ID NO: 7089 - DNA, 700 bp, Nannochloropsis_gaditana
ttccatattttcgtcctattccctggtccatccaggggaatcggggtggacaaccgcctccgggtcgggagggctacccccccgaggtaagtattcatgtcgtgcgtctcatctctaccgctaggggatacctgtgcctgccgtgacgtctgactcggcgcttaccatcccgatagggctattcttggcgggggccatcaccagtcgagggacttcagcgtcgccagggccagtaccccgaccagtttccggagcagcagccacgccccggctcgtcccctccacaggaaggcttctggtcccggctgacaaataaaatattcgtaggagcgaacgaagggtatgtgtcctcaaacaagtccttgggtgttgtgtgggcgccctcacgtgctctcgtggcccgtgcagcacgcttccggtgcccccatgcccccgcgacaagtggctcacaacctcgacccgatcggttacaccggcaggcaagacagccagggttggcaagacgcgcggcagcaaccatcacaaagacctctgttcccgcccgcggcctatcccggacaaggcccgccccccccccgcccctggcctgccctcgaccccagcgcagcaaccgcagtacccttcgcagccgcagaagccgcagccaggtctatctcagtacacagacgccctaagacctccatggcagccccccctcccc

SEQ ID NO: 7090 - DNA, 700 bp, Nannochloropsis_gaditana
ggagatgtctttgcagcggagggaagcgtcttgagcaagatgaatggggcgaaaagggccggctcccaacagggctcctgccagagaaactgcaaatgccgcaagcaaatccaacaccacggctgggacagagggactttctgtgtagtttatagatcgaaatcgtgtaagtgttgacattttcgaaattcataaataagtattgaagaccactcgcgaaccttgctgcatcgcacgtgtagaagcccgcgccactagagccagacccaccacaagcaaggatttcgaaagcaatgtcataataatgggttgtccacagcctgtctcgagagagttgtgggagatcagtggatgcaatgcgtccttttgagccggaacggaggcagtgagggggttcacgacggcctcgctgggacggaggggcgacggaggcgatcatcgaggtactagggggaaggcaaacccttaatttgtcagccagcccctcaaatactgatgcaggcttcacattattatgccggcttgatacatgccaacaaaacgtacttttcacggcctctggtaccctttcatgcagggacgacctctctgaacgttacgagcgacaagcaggatggtcgcatccggaggggtcgcagctccttcaaggagagaaagaaggtatctgcccaaaaaacatccttttgccgccatcacaatg

SEQ ID NO: 7091 - DNA, 700 bp, Nannochloropsis_gaditana
ggattgcttcagtgggaggcatactaaaaaaatcaggccagcttacgctgcgtcctcggattcgcgcgtctcttcttggacgtccacgtccaaagcctccccacatgctcccaagaaaaccctcactcaaacttatttggatctcggccagagatcgcacgggaaacgcacgctttgtggcacatgtggcctcttatacgtaaatggccaagaggaagacgagaaagaccatgtaaaattctgccggtctgttgcagctggccttgtctgccccgggtggcgggaccagcgcctagtgtggggtcaagaaggagtggacgggagggtgattgaggttcgccctggggatggagcggcgccactcacaaagatgagggaggtgaaacgtgtgatggatcaagaaatggggtttgttcccctcagagaaggtgatatagtgctcaagaccacagagaaggctttcttgtacgtgcacggaaggcgcgtagtgggctgcgtgatcgcagagaagataaatgtagcacatcctgtgtcaggaacaataccctcaaaggaagggtctcatgtctgcggaatgcaaaagcgttcgcgaggctcaagagtgtccgggattgctgactctctgcacggaggagagggagagggcccagaggggagggtacccgcggcctcggggcagaacgagcacaccgacagcatg

SEQ ID NO: 7092 - DNA, 700 bp, Nannochloropsis_gaditana
cggagttccgacttttcctcctcatgctgtttctccaacgaaagcatctcctcttggaactcttcttcgagttcttgcaaatcgcgatcaaatgctttttgtagtgtgtctacgtgagcgcggtgaaactctatcaatgtatcccgttgcttgctatgagcttcctgagctaaacatagattttcttgtgaatcagtggcatcagtttccaaaatactgagcagcttatctttttcctcgactgctttcccgtatcgaatggccaaggatctaatttcttcagctgctggttccatctttggccatgtcgttgtccgttgctggagtgcggcccatttttcagccaaatcgcgattagaatcatgatgaggcaaaggctgtgttacctcaccaattcgatgttcatctatcatacctactaagataaagaaatcatgctttatttcagtcgcaagcgcatatttggatcagatacaagcgaatgcactcaaaacaaaagagtgggattgcactttttggtaacggggagacatgcgtcatcgtgttcttcggcgagccttgggcgctgccgcgaaaacgtccccgccccccggcctaacgccatctttcattttcgtatatctgcaggtgtgatacacgaatatcgaattgtcaatactactgaaaattttctagcgaaatgaccagcatataagggatg

SEQ ID NO: 7093 - DNA, 700 bp, Nannochloropsis_gaditana
cgctgaaaaatacctcatagaaatttggtcgaatgtagatgcagaatggaaagcagttgccatagggattgtaccctttctcgtggaaatttactacaggattcttagcgatagtgacggcattttacaagtgacatcgtaaaggattaattgcacaaagaagttgacggcagtgcctgctctacataatggtggttatattgttaggtaaccctaaccctaaccctaacagaaaccatggcaggtctcaaagaaaagaattgaatctcttgactagctcttttttcattgcgttgttgtaggtgctgattaatgcctgaaaacaggaaattagactgcgcaatacacactcaaggacggaggtcgctgcttcgcttctatcgtcaccggggagcgcgtcaaattaattttaccctgttcctccgcgcattcacgcatcccgtcatccatgacaacagcacaagctgaaaagaattctgttccttgcgtcgcgtcgcctcaaattctggtgtttgcccgctgtgtgcgtgatcacgacgggatctttaatagacctcctcgccctctcggtggtgggaggccagcccgcgctttcctctcttgtatctcattcccttcgtcacaaaaatagagtaatttgtccgtcacatcagcccttaaatttcctttatcttctttcaaaccccatgctatggtaaat

SEQ ID NO: 7094 - DNA, 700 bp, Nannochloropsis_gaditana
  misc_feature (668)..(677): n is a, c, g, or t
accctcccggtcagtaaggtccccgtgctcgggccaacaggactcatctctccccaggctatacaagctgcggcaaaaaaattggaactcccggaggtaagcatatgtttcggtctggcaaagatcggtacatgcttacgcaaccgctcttaatgttggatttcaatgttgtcatcgaacctcctctctccccctcagcccccccccacggtcttattcaccttccttttcccgttcctccctcgcatcagatcgatcaagaggccgcatcttttgtcgccaccacagtcgaatatcacctccgcgagatattggaggacgcgatcaaactgcaaaatcaaagcaaacgccattccttgacggtcgatgacctgaatttcgtcatgcgcctccgtgggcaacagcctctgtacggctacggcgccggggcggcggcaacacaggaagtgacgacaacggacggagagcaggccacggtggtcctatcgggcctgggagaaagaaaagagacgcttgtgcgagccatgcagacggagctgcccaaggttgtgggcaggatgggagggaatgggtggaaggatgggagtccgtagccgatggaaggtgctttgagatcccattggcagttccgtgtagtccatgtggtggtatctgcttaacttgtcagnnnnnnnnnngagggagggaggacgagggggag

SEQ ID NO: 7095 - DNA, 700 bp, Nannochloropsis_gaditana; identical to SEQ ID NO: 6759

SEQ ID NO: 7096 - DNA, 700 bp, Nannochloropsis_gaditana
agaagccatgaaaattacactatcgcaaaaaataagaaaacaatgtacaatcgatagatatcgattcatatcgagcacgcctggtgagaccattggtgccgtgatacatgataagggtcaggggggtagggggtgcggggggaggttcgggacaacgagaccaacgtttgacgccgtgccttttccgtcaaagtcacccagcaattcgataacatgacaagcttacatcactagatgtgcattcttggctaccaccgtattcttctcgtcaaatgttgaaatatggtgtgcacatcgcgcaaggctggcacgtagaactgttttcgctgtcacctatacggctggctcgtcgttttcaatccctcgacatattttcacatttacgcagggcatgctccttccatccgccgttgatgacaatgaggccatggtctttggaactttaaactcactctgcatgactttcctctcctggactaggtagaattatctgcacgggcttcaactgaagacatcgccgccataaataataagcattttcccctccatcgtcatgcctagagtagtgctgagtaccagcagcaaaaaatcctgtatccttctacttctactgccgtccttggtatctgcattcttcgtcagaacccccctacccatgagcacagtcttgtctcactcacgtcgtactgtgtcctgtatg

SEQ ID NO: 7097 - DNA, 700 bp, Nannochloropsis_gaditana
gaattcaccgaaaaatttctaaacgtcggtacacattatgccgcaatagcgggccgttgttcatggatggtcaggcgcatgcttttggcgtttttgaatggagtgttcgacacagagagcgaggggagggaggacgacgagagaattagaaccaaccggcgcagccttacgtttgtctttttcatccaattctgcattgtgcaggcatttttaaagccacagatcccggcgtaagcatactcactacaacgacgtccaaatcgtagggttttccttggcgtcttgacgcatcaacaccgcgaaagggaacgggaaaatgactcaagcaagcgacgaagaatgtttgagatgaccggaggcactttcaaagtaaaaaccgaaaataaggttgatcgataccacctaagctatcccaccactagcgaggcgaaatagcaaattttttcttctatcagggaatcaaacactagatcgcacatgcccttcgcgatgaatgcaggttattatcttgtcggagtgaccacagcacgcttatcctccttcattcccccattcaagatgtactcatcctgccgataacgaacctccctccgtgaacaggcattattttcctacctttcgaaaagaaaaaggtagggaagacaggcacaacgctaccgtaccaccagctgttcgtgatcatatcgtatacctagtaatg

SEQ ID NO: 7098 - DNA, 700 bp, Nannochloropsis_gaditana
tcgacccaccgaggcgattggagactcgtgctaagtccaaaaccttcgaatgcccgcgcaaaacgcagcgctagatctctcatcgcttcaatttgctcctttgagttccctgtcgttgcggatgtgggtcgtgtcacgggtaggatgataatatattccagggcagagaagcctcgctgatggcggggccctttcaagtttcttcagcgacaggaaaaagggaagggacaaaagtcgtatgaatcaccgccatcaccaccacggcgaacatgcaaggcaccgacatgtactccgcgcttgtcgccgttgccacacggtcatttgcgtgggacacggtcattctttgattgtgttggggttttggtctggtgggatagatttggtcgggccccttgccctcctacccctgacccaaagggtaacctcaactgacgtggggcagcgtgcatgttcccgttcccattttttaggcttgattgacacccatgcccctccaaaaggcagcgatcgagtgagattttgtctctgtacagcatgctattgcgtgtttggccacacgggcagtgctttctggctttatctcgatgagggaggagattcccttggagtgggcgcccctccgtcgacagtcgctggtaacttgctttctcattcgacgattcgtactcttttgaacggtaccacaggtaaatagaccatg

SEQ ID NO: 7099 - DNA, 515 bp, Nannochloropsis_gaditana
cagaggcgggtcgtgccgaggcccggtaccggggcggcgagggggcgggaggccgccagcagcagcccagcctctactccatcttgaacaagacgaggacggcggcggggtcccggtgcctaaagcggtggggaagagggggagcaaggggaaggggggctcgagcgtccttcgaaggggaggaaggccggccaatggcctctcctccccctgtaggcgcaagatggatctgatcctccctcccacgccactcgcgcccagcctcatgaggctcccgcctccaccctgactgtcttcccacgctgccaaaagggtggttgtgggtggcagagggtgcgaggggggtctctggctgggacggcgtcgaggggggggaaggcggctgtttgcgaggttgagaggcagtctccatgcgtcttcgactcaatttgcccgcccacagccctttgacgggggccggccctccccagcggatcggttgagcttaccgcgaggagggtctccggccaaggatg

SEQ ID NO: 7100 - DNA, 700 bp, Nannochloropsis_gaditana; identical to SEQ ID NO: 5720

SEQ ID NO: 7101 - DNA, 700 bp, Nannochloropsis_gaditana
acagccttcccgcaagaagctcatgccaatttaaagcctgggcaaaagtcatccgccatgccagctttacgtcctaaaagagcggataaaagaagtggaagatattttgggctctatgctcttcatatggtagcgctagtcctgacgatcatcgggtattactccttcacagcaactgacacgacgaaatatgccctccagaacgcaatagtaacgactgactccggcgcacagagcaatcaatcttctttgagagaagataccaatactacgtggtcgtctcctccatcaatcacattaagtgacacatataaaaaagttactaactctgttgcaggacattctgatgcgaaggtacgaggaagagatacaaaggatcaaaggaagcagagaaaatctctaaaatacatgtcgaggggactcgaggggattagaatttacgcacaaatgtactctaagtgtctaagtgatattacatttgaacatattttgtcagggtggttgcaaagccaaggaccttggatatcaatctgtgaattgtccctactgggacgcgtcagcagccgaccctctttccttcagtgaacctgtggactaccgcgtacgctatctttggcgaagacaacatcccatagactgcaggaacgctaactttatagcacagtctgcattgagtggtcttggttttggcgcagtgatg

SEQ ID NO: 7102 - DNA, 700 bp, Nannochloropsis_gaditana
ggtgacagacccacacagcaatggccgtccatgaccgcgatggttgccggcgtggcccctccggctgagacgattttttctacctctcgtgcagtttggagattggtagggtatggcatgccgtgcgtgataatggtggattccagagccacgacgggcttgtgcgcagccagtgctgcctggacggcagaagacagacgtagccctcgagggagagaggcatagcgtgctatcgctcgatgccaaggtatacgcattccttggacgtggcggaaggagggacgatacaagcgtggcatggctcgtgccgatttctagcgagcgcagcagcttaacggcaggaggcaagcgggggggcactgggaggtaaatggtcgcagacaaatgcttttctctgtcccacaatgacacgcacagcgcaaagatgtgccatgcgctgcgcgggatgtccaagtccacaacctgatatgggaaataccagaagaaagaaggatgggacaaaattttggtccgccggcggcccccattttcctctggcaaaaatcagggggggcgtgacacgtcccgtctcacgcggcgacgcatgcccgccgtccctcccagcctgccttggcatttgtttttccagacctttccccggtgtctgttcccttccatcgaagcacctcaccgcaccaattttatacatgcccgacgcagg

SEQ ID NO: 7103 - DNA, 700 bp, Nannochloropsis_gaditana; identical to SEQ ID NO: 5713

SEQ ID NO: 7104 - DNA, 700 bp, Nannochloropsis_gaditana; identical to SEQ ID NO: 5714

SEQ ID NO: 7105 - DNA, 700 bp, Nannochloropsis_gaditana; identical to SEQ ID NO: 5715

SEQ ID NO: 7106 - DNA, 700 bp, Nannochloropsis_gaditana; identical to SEQ ID NO: 5716

SEQ ID NO: 7107 - DNA, 700 bp, Nannochloropsis_gaditana; identical to SEQ ID NO: 5718

SEQ ID NO: 7108 - DNA, 700 bp, Nannochloropsis_gaditana; identical to SEQ ID NO: 5719

SEQ ID NO: 7109 - DNA, 700 bp, Nannochloropsis_gaditana
gcgggctgcctcccaaagctgcaacgtactcgcaaagcttgacaccttccaatgcacttcgttcatttccgttcgaaggcatctgacgcgtgtacgtgcttgcatcccaattttcgctgagaaggcattgtggaatagacaatcgtcgtcttaatgttttccaagctgggaggatgggcaaatcatcgttcactttcatttcctcagtcaatacgttacctcctccaacatacgcacacacgactggggcactgttctcatcaaaattgttacaggcaaaagagatgactcgaatttctcctgctccttcccatagctcctccacttcctcccttccaaacctcgttgggtgctcctcccactcctcgacaccccccccccaactccctcctgcctccccaatgacgccgatgaataagaaacagtccaagggcttgtctcctgtacaagaaaagatgaagagtcatgggaaaagcagaaccggaactctgcgtattgtgatcaaagggatgagaaacttgaaggcaagtgtgatgcgatacatgccattgtgatcaaatcggggtagagttcccgtcatgtgtccaacatatgtaatatagcgttatgaattccatagtctcaggggaatgaatcaatctccaagagtcgtcttttttattcgacgcgtccgcattcttttttattttaatcacagcat

SEQ ID NO: 7110 - DNA, 148 bp, Nannochloropsis_gaditana
gatatatggccttcgttcttgctacgtggcttcccacggctgtacagatacgaggtaatccgtttgatcggggggcgcacggatcaacaattttaactctccacgcttttcctacttcatttgctcctgttaaaccctgacacagtac

SEQ ID NO: 7111 - DNA, 700 bp, Nannochloropsis_gaditana
tcatgcacaagcctggtcagtggctctaaaatcccacattattctcatctttccgtctgtatcatcatggcgtcattcctccttctcatagccacgacggcctgcatttcccctgtatcagccagtgacgtttacctggttatgagatgggtcaaagcaaactactacatataagattatcttacgaccgctcgagtctgtgcatgtgcttacagaggaggatggggaagtgaagaacaagggcaatgcccggaagacctttcgagcttgtgagaagttgtagctaccatagccacttctgtcctaactcgcacaaaatcatggctgtcatcgctcgtatcactgttgtatgatcgtaaacgatgatgacagccactggaactacgacaagatggcaaggttcaagtaaagcaagccttgttgacttgaaagggagacagcatgaagcgagaggcgagcgcaggctgataatttgctcgtagcaattaattcgcgcctctaatataacccctcgaattattgcttcttaaaattttacctgtcgcctgacatgaatacaacttataacggggtcagggggagcggtgagcggaagctgctttaagggagtggtttgctgtttagccccgggtgctgccaagtggaaggggagagggatcgtatcttgcttctctccctccttgctacgaagtgcacaatg

SEQ ID NO: 7112 - DNA, 700 bp, Nannochloropsis_gaditana
tgagacgagcgaccgcactcaaataggggaagtgcgaatttacatatgttgcactctccgtaaccagccattgcatgcttgattggagaaagcgcagagcaactgatggtagaaaggaacgttgtgatgttaggtcaaccggaaagactcttgaggtgacttagaagcggagtgacatttatacacaccatttttcatatcaaactgatacgtctctgacaatcgggttgcagtgctactatatctgacgggcacgacagagaaaaatgactggtaaaagaaatatgcacgacagctgggtctcaatcaatttgtgcatattggtagagtgtcctcctggatggcacgcctgattttttcaaaatgcaaaaccaaaaagcgggtctcgtaacctccccacccccagcggatggggcgaggtcccccgtacacagcgtggatggatggcttttcacggaggcgcgtctctgtgacctttgtcagaaactaatcgtttccctcaccctctggagctgggcgtgactgattttccacgttctgcacgcttcaggcacgcattgtgggacctggaggcagggggggacggggaaggagaacattcagtccttccaaagcgatggggcttcaaccgggattggaaaggcccaccttccggcgacctattttgccatcctacctttatttcctccttttctccatg

SEQ ID NO: 7113 - DNA, 700 bp, Nannochloropsis_gaditana
tgcaggaaaagcatgtattttctccatggccgcggaagagacttcccaataaggaagtgattctctgtccgtgttcgtgcgatcgtaagaaggggttagaccatcatttttcacagcctatctccgctgtccgtcactgcattttttttgggcgaggcttttcccatcctcttcccgaccgtcacgcacggaaaaaaatccgtgcggtggcggggatgaatatgctttgtttgacccgataagtcgatttcaacatctggattcccctcattcatcacgccatattcgcatatgactaagtttgccatgcgatgcgcgggcgctcgtggttgtggagcgctagtagaggtgcagcagcttggatcagatcttgtatcattctgtcgctttatttattcctccgtatgccaatcccgctgactattgagatatctttggttttggcacgggcctgtggtgtcttattacgctcagagtatgcttgcccttaatgttttagtgtacagacatgtagggcaaaattttcatgtgtccggttgggcgtgagtctatcttccatttcaccggcagaggagtgccaaaacaacgcgtcgtcacctccacctcctgatctatatacgcaaacacaccaatgctcgaacacaggaggaattgtgtccgtatttttgtcgtcaaggacaaacgtcgtcctatcaccatg

SEQ ID NO: 7114 - DNA, 700 bp, Nannochloropsis_gaditana
actatatttttccaagtctataatccccacgagcacatgctgagaggcacttccaccctcgtcattaagtgagtgagtgtcttcgacataccacacgataacctcccccccctgctaagtagtcagtcacacatttcgacagcaggggggaaaagggaatggggaatgcagcaaatgcatcttaggcccccgtcagcgtgacaactgtagcaggactgcctgtagcaggactgcagcaaagcctgcgtgctgggccaagttcaggcgaagatgatatctaagtgtaacttcctcgctaagaaggaaacctacaaaacttcgtcagtgaacctttcatgaatgttggcccgctgtccttcctctgagttcttaagtaccaacgtaggtgcctcgagctctctggcctctatccatggcttcgagacactcctaacttgtcgctttagtgaaaatatttgacaaaaacggcatggcatgcccgcgtacgggcttcgtgctgtccaccgccggagctcgctgatttatcagcgtcaactagacatatgacatggaggacgagggacaggcttgcctttctgtgtctcgaggccattccacatagcttctgtggtgacgctttcattcttatttatgactttaactattccaatttatcttttgggcctttcctccagtcacgtggtctcaccggagggccatg

SEQ ID NO: 7115 - DNA, 700 bp, Nannochloropsis_gaditana
ccctaacagcacagacaagactcgacaatgccctttatctttcattccaccaaaccaagtatcgagatagttcactagcctctcccctgtggaccgctcacccgtgaacaaagccatccccagccctccgcagacaagaaggagccggcaccccgcccggtccaccaggtagagggcaaggaaggtgctgaggtagttgaggagggccacggccaaggtggcgaggatggccatctccgaggcgaggaacttcttgaagatgacaggggcgaagtacatgactagcggcatggaaaagagcagaaagagaggggaagggagagctgagcgtgccaagcgttgacgccgtgactgtccctttgttcggtgaggcgatcatgctgatttggacactttggtcttctcttatggctaactctgcctgatgccgtgattctcttggacgccataccaaggcagcagctgtacggggaccgctctctcgcacgagttatgacaccgaccattcttctccaaatccctctccggccctactcgcctcgctttctctcctacacctgcttgctgtccttgtgcgccttcccgcgtctaaccacaaatatcatcccttccctcatatccatctacccttcacttgttcccctccgtcagtgggatgaaacctaccgcattgatctcggagaactgctccaacagcatg

SEQ ID NO: 7116 - DNA, 700 bp, Nannochloropsis_gaditana
tttgaaatcccaaagcgagggtgttgaactcgtcaggaacactcacacagatggggcggacagtgaggaggttaatttcagccctctttctccctttacagccgtctccacgatgacaatgtaggctggcaaacactgcccacgcacctaacatcatgtaaaggactactcatgccattggaaaggtcgtccttttgtaatgcggaaggtcttggccggcattactcctgctttgtcgtgtccatcgctccgggtcgctgaaacgtccccaaggccagattttcggagtctttccgcacggggacacagggctacattacttgctagggcgtccgacttcgcgagtatatcgaacagggtcaagagtgtggtgagattcgatgagagtcagtgagatagtgtgtgctgggctctactgtgtgcgacctcaatggatcaaaaacgagaaagaaggatgagcaaacgcacgaaaaagctgattctgcgaaaatgacgagcgggccccctcttcttttgtgctgctgtgcgtagttacttagcataaagaaggcaggggctgaatgtctcattgctacgttccacttgtaatagtggacgcattaccgacgaaatgtgccagccagatgcctctgaattctcctacattttcgatgactgatagcataacaatatctcctccgacgtaccacttaagacgatg

SEQ ID NO: 7117 - DNA, 700 bp, Nannochloropsis_gaditana
ttagcctagaactcgactgaattgagctttcaccctatcctcacgggtttgcgccttccggtttaagaaaatttcagtacatatttgaaaaacacaaatagaacatcgcaagaacgtactcgtcgcagcctcagccacagcgtacatggacttgattaaagtcctatcattcgttgtcaagagttctgtcaactgccgcctagagatgtccagcttttgtcctgtgtccaaacgatcgaggccaaggaagtccttcaagggtgaccaaagaggctcagcaccccctctcgcagtgcctttgtcgctggcatagcgtattgtgactgacagtggtcgttggcggcccaaggcgcgagggcaggcgcatgtccaaaagtgtcgggctcgaaggatctgtttggtatggaaacctaggcagctgccacagaccgaaagcaccgccacgtttgcaggaaaataatgcagtgttcggggtagaagcatgccgttgcctggcgtgagtgattgttgcatgtgtgagaatgcgaaagtgactttgaagacctggttcagttcttcctgacaaagttgaagcagaaggagagacgcaattcaagaagcgtttgttccgctttcaagcgagacagccacgcgttttccctctcatctttcctacggcctctcattcaggatagttgagcgtgtgccggtccctgctatg

SEQ ID NO: 7118 - DNA, 99 bp, Nannochloropsis_gaditana
aaaccccctcactgtgctacgttcccccccccccggtacctgcccgcactcgatacacttggtccggtccaacggcagcccccgcgtggtcgacacatg

SEQ ID NO: 7119 - DNA, 700 bp, Nannochloropsis_gaditana
cattcctcttcatttgcgtcgtccacgccttcctggttgatttccttcacttaccccctacagttgacatgccatgtgagttcaacccaagttgagtagtaaaaccattaaagagataagtgaatctgttactcatgcaatttaataatcccgcagcgctgatattgaaatacatcgtgattggcaacacgaatgtggggaagtcctcacttctcctccagtattgcgaagaacgcttcaatgaaacccatcgcatgacggtgagaagcatcgaaagtgctgcttgacgagagggaatacgatctctctgtttccaacgcctccctcgcgccgcccgcatttgttataaacctgctagtaagctacggcattcatctcacacgcgccgcgtcccacacttgtggccaggtcggggtggagtacggactcaagtcggcaaccgtcagagaccaaaacatacaaatcgagatctgggataccgcagggcaggaagcttacatgtccctaacaaacaggtgcgttccatatgaaggcacggttctctccctcccctctaccctccctggacgcccgctggcagccccctttctcttgttcgcattgtcctgcatatcagcgtgggaaggaacggagactccccttgccctagccaggcccccccgccctgaggctaccccggataacccccccctactccatg

SEQ ID NO: 7120 - DNA, 700 bp, Nannochloropsis_gaditana
tgcccttctgtcctccgaaattgaaaggtgcctttgccgctttcattccctgcgttgtgtgcgtaatcgacacggaagtcgcatcttaagagtgctttttgcgtgtgtcacattggccttggagactcgcctttctcagcgacgttgtagtactactagtaggaaacgtcaatggggcgaggcaggaggtaaatcgaaaatgatccgttcacgagtttgaaaggacgaaccctcgggaacgtggcgcagtcttgctgccaataccgcattgtacagttcatctaatgtttcccgggggcgcaaagtaattgcggcccgcccgctgggtttttgggttgcgaaagactcgccaccgccggctcgcttttttcatgaagaaggagagagctgtcatttcgaatagtaaagccgacggacgggaatttgggaacatcacggcttaaatgcgtgtgtggcagatttttttgcgtgcagcgacacttctgaagtggacggcgtgattctagagcgctcgttggtcgatgtctccgtactctctgcccccagtaataaaaagaaccgagggcccatctcaagcataggacgcagagaataaaacgctttctcgtatcgtatcgaattcttgtctgccctgattcgcgcctcctcgtttcaaacacttctcatcattactgtgtcccagtctaggcggttgaagatg

SEQ ID NO: 7121 - DNA, 700 bp, Nannochloropsis_gaditana
tattttaccaattcaacagctgttttttgcatgaagggactgggaagcccagcacagttacgaatgcgctattccaagcttaaccgaaagacgacatgtgctcctactccagctccctctatcaatcctgcacaacagttcgtccttttcggacgaggacagcgtttctcgcaaggaagcctgcgcgcaccatttgaggatcgccgtcgatctctgcactctgagcgtactaatgcgacggccttcttgccttctatggaacgcgaaagtcggaaactagatatttccacgccgaaagattgctatgaatattgctcgctgaggagaaatgaactcgtgcctttttccttcaactggaatactgtgacaaatcagtgcttttgctgcgcagatgtgtgcaccccttttgtgtttgatcccgcatatgacatgtatgaggtgacaaccgctgcaacggcggtcccttcttcagctcctaaaagccctgaggtttccactgcggcccccaccggaagtcctgcatcctcccccacactagggcccagcgcaattcgcacttcagctcctacgtcagccccaactgctgcaccctcatcgttaccaacgatcgacacctaccccgtcaattcaactttttcccctacgagtttcaccccggctccgaagccctctaaacccgttgtggttcctacgcccgatg

SEQ ID NO: 7122 - DNA, 700 bp, Nannochloropsis_gaditana
ctttattacttccacattagattgaccaatcgttggagaaatgcggcaaaacggctaggacggggaggttaataatttctcataaggattgcgataacataaaagaatgccgaaagacattttaaaataaaaatactcattaagtctctcaaaagaaaattttgtgaatctgcatcttcctcgatggagacccttggacatgatttttcctctttgcttttaaagtgctttttccgaacagtgtaacgtgccgtgattcaaattttgacacggtcgggtcgaagcaaataaggacgtcggccattcctagtccattcaacacaaatgccgtcaatgctgtggctattgctctccacaaggatttgaatatgctatcaagaccatatgtctcctaaacatttgaagctggtcgaactactttctaaatgcgcccgaggcggcgcccatccgcccagctccaaggacagcgagctccagtatccttcaagctctcaacgttgacatttattaccctcctaacccaattttaacatcgttgtcacggttgaaaattatttttgttaaatttcacgactagagcaaagtacaggcgttgctgtacatgcctgatactgtttttaaaatacatcgaccttctcccaacatttctcaggactctttgcgatctgtcggtgtaggagtaaagtgaaaaggccgcatg

SEQ ID NO: 7123 - DNA, 700 bp, Nannochloropsis_gaditana
ggggaggtggaggacatgaaaagcttaaaatcaccagaaatacaggtaatttgcagaacatcacccgactgcattcaatggatgagtcgattacactactcttgcgttgacgcgcggtggaagcgcgtccccggaacattatttcgtgtgatgcatagggtatttccgcccttccacttctcggggcttctcatgtcgctctgcctccctcgctgacgacaagaataccaggtccttctctcgacggccacgtcctcgtgtcgcagtcaatcgtgcccattgcgtcgaaaaaacttcgttttgaacctatgaaaaagtacgtatcgcaaagtggaaaaaatgaaattcacacgcccgtgatgagatggaaaaatgaccaaagaattgtaatgtcttttaccgacggagacaatatgggccaattcaacggctgaatttcacagttcacggggaccgctatgtccaaaggatatcaaatgggtaaaatatggccattaaatgtgcatggaaaatgtcttcgtatctttatagggatagacgaggcctgcattttttgtatgctgcccttatgacctcatggcttgaacggctacgtcccctgtggcgaccgggtcgaagcccgccatctctctccatatagctaagcaatgcgatcatcgattcactccaaggctccctttttttcttcacaaaaagcatg

SEQ ID NO: 7124 - DNA, 700 bp, Nannochloropsis_gaditana
ttccggaggcccctgctacgccgatgatcgaagcagcatcttccttttccatttttgcggcggcgtcagtggcctccccatccaagcaaagcggggaggggcgggacgctgagggagcgagttcttccccatcgacacgggagggaggtgatgctggtggcctggaaggacctgagcttccatagctgctcccatcgttggagttggtggtcatttatttcgtcgagtctgcgtgtgaggagcgtgggagcgggttaaaattacatttgtgtcattcaaggtacacatgcgaagtgccctccaggcatcggcgatactctgactgcaagagcgtactgccgctcaatatgagcccaacaccgacagataatgcgagctgtagcactcaagaggcatcaaaacaacaatattcgtcagaatacggctcattgctggacggcagtgtatactgacaacgttgattttttcttgatgtaaagaaggggggctggacaaaattgagggtggcggtgaaagttgaagcgtaatgcataggcaagtgtcacgatcaataatgatggagtactctttctacattcatttatgtaacaatgtgatattcagaacacacctttacaagatttgagtaccctactgtgccatttttcgctggtgtccgtccgcagtggctgtggggaggacgacgcgtgagaaagcgatg

SEQ ID NO: 7125 - DNA, 700 bp, Nannochloropsis_gaditana
gactctcaaccgtacaaattcctgaggaaggaaaggaggaagggacaatggatggagaagggggaaacgataatgatgaatctagcaaggaagcaagagaggaaaaagcgggctacctccgagggacgtgcctgcctggatactccggtgggatatgggccagtgacgtcattctttccgaaacgtccggttcgcgccaaaatgagattggcttggaggaggaaaatgacccagccctgcgatcggatgcgtgccagtgcgtggacacggccatggtcggagcgaataggggcgtggtatggcgaatggaatgtgtaaatccccttatatctttgtttttggacatatcggacgatggcaatgagagttgatggaaaaagatggaaaaaaagtatctgtgatactatcccagatctccttgaacctctctagaggaaatgagggaggatctcaaacgtagcgccgcaaattcttcgagcacatcaattatacgccacgggttgtatagtagtcttttttttttgtttcgaagtgagtggtcacggtcatgcagatttatcaccacttatccggattgcttggacacgctctcacgaacagagtacatgggcgatttgactttttgcgccgtccttttaacaactgtacacaggcaaagtagtcaagctctgcttcatacctacagttacacaggcttatg

SEQ ID NO: 7126 - DNA, 700 bp, Nannochloropsis_gaditana
tacgacggggccagggcaactgcgactatcaggattgagtactggcagtgacaaagtttacgtacctcgccagcggtcctgttctccaattttctggaaatcgactgatgaaaaccaagcttttcttttttcatgaccaatattcggatagttgtgtctcaagggaagatgaaaagcgtggatgcagtaagagcaggagaagactacgaccaggaagatgaggaataaaggcgtcgctgtacggcttaccgccatagcttgcccctgaaaaatgcgttacacctgtatcaaaatgtatgcaacaacaaaaaacgcgcgggtcgtggggtaatttcgagtaagtggtggctagaatgaaaggcaacaagcggatactggataccgtcatatcgctcgagtcgccgcccaagagggtagagaaactatttacgtcacataagcgaacacaatgccacccttgggccgcccgtgcgtttctcaacgagccattgtacagcacatgccaacgcacgacatatcgtgtgctgtgccgtggtgcattgtgacgtgatacctgttggcatttatcaaagtccgcatgctcctgagggaggaacccatgcgtgcccggacccggcgactgttgccctggtcttccttcaccctttctcacgcttttctcgcacgcacacgcaggctcgctggtcaggttgccagcatg

SEQ ID NO: 7127 - DNA, 700 bp, Nannochloropsis_gaditana
acctcagcgtcaaaacaacgacagtaagggccagataaaagggaaacgggcacgatatcgacatccaacaagcagatgtggccgcagtagtcggaaactgtatcatatagcgggaggatgagacaagtttacgttctcagttgcccagccgcttgaacccgttacttctgggagggtagctacgacccaatcccaggggaggttaccgggttaccaaatgcgacgtccaaccttacgccgcaaaaacttctttttggttcctccctagaaagcagcatattgtaagatacatgttgaccgtatcttacagagctcgttgaaccagggacatcggaaagaatccttgatggaggtcacgaggacgtacgagcgtgatttggccaagttgcagcaggaggttgggattcacaatctggccgacaaaagcctggcaaacgctttagatgagagaaacatctgtttcagaagccagtttatcatccctttgaacggctctgcaatctatttgtgtactaacagcttggggcttcaaccccggcgtctccgagacgacgtcggggaggtcttaaataaatggggacaagagggtgtgacttcttggtttcgggggcgcaagcctttcgccaatgtagatgaatcagttcttgatgaattggcatcaataattggagcaaaggattcacatgaagttgtggccatg

SEQ ID NO: 7128 - DNA, 700 bp, Nannochloropsis_gaditana
cgcgtatttgtgacctttctagtcagcaagtgatgtgctgaaatcaaatcttacagaatcggttttgaatttgcaacttatttttcttttcaatgggaagaaggcagcccaccatgtagtgtgcaggtcacatactgtctcgttccggcctcctagttgaaggcgtatctttttgtcggaacccgttggagtggggccttccagctgagcataactgaggcactgccaactttgcgacaaggagagcaacagctttgtatatcaagtgagctgctttgtccgccaaaaatgcaacggacatgaggcatttggggtcttgaacttaaatcgcagatctgtgtttgcggagggtgggattgcttgaggtgcatccaaaccgctcttctcgcccgcttcgcactcccttcgttgtctcttctcaactttgtctcaaaaagactctctccactgacttgcacccttctatatcttcattagtcttgttacttccattttttgtcgcccaaaatgtaagacatagccattttattgttgcgcgttagcgctcgtcttcctgcttgctgttgccgcctccgcgtagggcagatcccatggctaccccctggcccttattcctttatcaaagcaagcgatgaatgtcgtgtaaagtcgatctgtacatttcaaacaggacatcttctttccttcgtaagccaacatg

SEQ ID NO: 7129 - DNA, 700 bp, Nannochloropsis_gaditana
cgttcgggacttaaacgattgaatgccaacaactttcccaccctcgagcaatggcggtgcaacaattgcgactcggagcttatcggcttcgaagacttgaaatgccttcccgaccgttgtggtgatgaaagttacaccccctagtctattaatgccgaaaggtgccccatccgtgatgcatccaatagcccgatatggagcgaaaaggcgactgtgctgcagtgtccgcgtgtgcttatgtcttggaagagctaccattttttaagtgaagttgtgctgaccagccaggaggttggaggcgactctgtagctaggacccgcgggtggacgacaaaacaacacggtgacgacgaggcgcccgcggacttagtcgcctaatgcacgtcctgagcaggactggtgggtaagacaaagtgagtgtgagttgtggaaagcttcttatcttgtgaaaaacacggttgtcctaaggaggacggtcctgagcccagcaaaccagccaccgactatcgcttacagcagtgcgacgcaggcaggaagaacttctatccctgaaaaggtcgcccagtccttgccacaggtagttgaaaagcgttcgtggcactgaatttccagacgcagcacaaggagctggctacctcactcttgccgacccatcagttcgaaaagcaataactcattcggtcggcccgattcatttcta

SEQ ID NO: 7130 - DNA, 700 bp, Nannochloropsis_gaditana
ccatgtgtcacgtatcaagccgcgtgacacaaactcaccgtctggtttaagaagtgtcgaggccgacaaaatctgccacgattcttccattgcggaatacaacggggccgatgggcctctgcgctgttgtcagatcaaccgcccaggcctccagtgtcttctcaccccaaaagtcagcaggaaggcgtcgccccctacttctgcacgtcacacagtcattagtcagggtgaaatggtgagtttgggttgacagtgaaagcggcgaggctgcagcaaggcgctcggcctcttgcctgtttccattccacgcatgcgtcctgtttcacaggcgaaaccttgaaagtctatacacatgcttatcctatgaggaagtcgaccataatcatcctttagcactcgacatacacagggaacacgtgcctgggccgaacactgcattgttgggagtgtgtcggcatcacgtctgacaggccggccaacctccccccctactttagtaggagtactaggagtgctactcccccagtcaaagctttcttctcgcgccacttggatggacgccccgcgtaacagtatactatacaagattttcttgcttctattcgcgctccatatgcttagccgctcttgggcctgggtgacgggagctttccctccactccttcgaacgaggagctgtccctatggtagcagtagtatg

SEQ ID NO: 7131 - DNA, 700 bp, Nannochloropsis_gaditana
tcacatttcaagggcgcttcatcttcgaaaatgaaagagtggttgaacaaagcaattttttaccgtacccaaatggctttctagggcggcataggacaccccgcggggcccggccctggcggcgattatgccttgcagatgcacggcattgacaattggacttgcttttgggaaaaccacacctttcgctttatgccaccatgacaaggccatttcttcctgtcgaagtaaagaaatgaataatgaaatcattggaaaacgattttctgcaggcgtggggaggttaaaacgatctgcgttgtcaaccttgggcatttttgggtgacataactggcattaaatgaagtgtatgtttattcatcagattttgaacaaaaaacaaatttacattgcagtgattgagcattcgaagtcattcgtctcgtgcgcggggaacatcacctcgcctcgctggaagagctggcaagccgtgtggagggagcctcggctgaactcaacacagcgccccacacggaaatcaattgtgccatatcagccaccttcgtctaccgaatcgatatggctgacttttaaaaccagctattctttttttgcctgcgttttttgagggatgacagcctcggagtacatgattaaagaactcaacaacccgggccgggggctcgagcgagagaggggggggctcgcgatgacaaagatg

SEQ ID NO: 7132 - DNA, 700 bp, Nannochloropsis_gaditana
gaaacaaggtcagaaaacacctcccctccgtgtaacggttcggaattccggtccgtccccgtttgaatttctcgaggacagtccacctggcccccgggggaacaagtacgccacatcccgtgctttgcaggcggcgttgcggtgcaccacgtccttgtgctgcctagattttcgctgcattactattgtagcacaagtcgagctttgctcttggtgccctcacctgtggcacgagtattagtgcgtcgattagatggcagccacggcagggaagggccgattccgggtcctatggccccccatccctatgccatcaaaagcaaatctcactccgaaacgtcccccgcgttcacaagcaagcacttccaattcgatttttcataacctttcgataacatgttttgtcatggttgataaatgtagtgttacggagaagacataccaggtttggtcttggatcaaggttccgaacatccatgtcgtgcaggaagaacatggcctgcgtggagaagtcgctcgtcgtggcgtgtacaatatccatgcgcacatacaagtctgttggctgtagggaaaaaaatcaatagagagacagtcatgtatttgcgcggccgggtgcttctgtctatcaacatctcaatcgatttcttgaacacatgcagtatttccataggaaaaatagaagggggccatcatcttcatg

SEQ ID NO: 7133 - DNA, 700 bp, Nannochloropsis_gaditana
tttctgtgtcacgaatgcccacaacgtgtggatgctccgacacaatcttcggtgctgcgcccgtgcaaataagacatcggtcaaagggaagaaagctatcattctcgcattctattctgtggttgtgcacgtccacagacttgacgttcgcctgtactatccgcaaattagcatgctcctctccgaacgcatttgcatcccgttgtacgacctccatgtcctccagctttctcgtcacttgcaccaccttgcccacgtgcttgacgatcggggtggctgtgatcaaggtcacctttacttcctccggggagacgatttcaagcaaatcctctgctgctgtacaacctgcgatgcctcctcctactattacatactgcttgcaataatttggttcaccgggacccttgcatgaagtctcgctggtcattgctatctcaagtgattgcccaacctcagcctgtgtacacatggtaatggttaataagcgcgacgcgcgttaaaggagacctcggagggcgtgactaggtttcgtcatcctatgatacccggcgagtcaaggcgacaaggccgtggccccaaaacacgtctcgtttggctattcttctttccatctccacgaccatctgtactctaccacccatgagactcattcctcccgacaccctcttgcatatgcgggcgcacacccggaatcgcagtt

SEQ ID NO: 7134 - DNA, 700 bp, Nannochloropsis_gaditana
cagatgcagagtagtggagtcaaagttgcgtgggacagcattagtgtcgcggtagacattccgctgtgtctccacacatgtgccgtcggagtcttttccttctttgaaatgactagagaagactccattctcctcaattttcatcggctacccgtgtctccgacgcgtaactcgatgtcgggaatgttacgacctaggcatatatgtggagtgctgcgcgggtaaatgggttgcacctgcatgtgcgggaaagcgacaaatttgacaccagaacgccaaatagtctgccttgcatcttccatgttcagcatatcatgcatacctgtcatggataacagaggcaacgtacaggaaaaagtgcggccacgccgggttcagagccctcgaccgcaaacttcaactcgcgtctcgtggcagccccttccctccccgactcctgtgcccgccctggcacgccagcgcacaatctgtcattcactgacctggatgcacacaatggaaatgtgaagggaataaggagctgtgcttggctgaggctgtgccgatactttctgtcttttgtctcccgggcaagtgctcactttttcttcttcaactcacctcgcgtcaaatacccatccacagcttgcgctgctttcaagcacaaagcaaattaagctcccgcctccctcctggaagcttcccatagccagcaactatg

SEQ ID NO: 7135 - DNA, 700 bp, Nannochloropsis_gaditana
gcctgtggtctaaattattttttgtcgtgaaaaatttttcataatgctcacacatgaatttttcctagtgccctgatcgactcctcgcgccccggcttcccgattcggaaccatgtcgagacgcaggaaattggcgccatgagcccgaacttcccacattcccctcctctggccttggcgctcttcttagcacacctgtgcacccgcacgatcgagttattctcataaggacgtaactcattgaatgaaagctatgtaatacgcgctttacccgatgaggcgtttcttcccttgtcttgacatcaaattagaaagttgcatcatcgcgtaagcccatcgtctgctcacgatgtcgttcatcactacacctcatggccacacagagacgtcgacgcttccagtcgtgggtaacatgtttttgagaatacggacggttctcgcctatattcgcgtctggtacttttcgcagtcgtcctgatccggacgccacttggaaaggagggccaattgattcacccagggctcctcgtgcatcccagagcgcggttcttgggaactaataatcaaagcattggagatcatggatgaggagcttaatgttctttcgcctttcttagtgaaggcagaggttttgctcgtccttgtggtggtcctcgttgcatcagtggtgtggttattttgggaaattgtcagcttcatg

SEQ ID NO: 7136 - DNA, 700 bp, Nannochloropsis_gaditana
gcaaggaagcgcactctatatgattattggtaccatgttttgttaggaaatggcattccaaggacggaaagatgctgggaggagatagtcgccggcggggttgcttgagcatttgatctttccgaggccaactgctgctcctatcctccttccttctcactatgtctcaatatttcctttatttctccaacttctttcctctaaattttgcgcacggtgcgtgcgctcgcaatttacttgcgcagtgcattttatgcgactggtggcaatgccagcctcctcagtcccctttttttcttggaagaaccctgtatgccatgttcgaccatcctcttggtggagatcttcctgccacaatgctttcacgtgcgatttttttgccctttttgaaggtgttctcggttttctatctttatggagagtgctcgacagtgacatgccaatatttcacgcatgtgttatttctttaagcatgcttcgccatgttccatccttcaggcgtgtgcccctgttttccgcatcgcgacctggaggctgcaacctataaagtactggaaaacctcagagaaagactggtaacctccttcaggccttaccctcgttcatcctcggtactaagtcgcttcatcgaccctcccttactccatccccagatcgtaccttcacgtaacaacctcccacccgacttaccacaagcatg

SEQ ID NO: 7137 - DNA, 700 bp, Nannochloropsis_gaditana
tacgcctctgcgggaaaaaagcggcatcgtcttcattcatacacatagcttttactgcgggtgtaacaagcatgcgatacagtgaagagtagaatttggctcaggaaccgacgcgaatacttgcacttcttcaacctcaagaacaccgtatgtgctggttagtctcaactgtcccgcatcaaccacgcgaatcaatctcacataaggatcgcacccgccccatccataccacattccccatcatttacaagttgcatcgtgtgactgtcggccaacccccgcgagtctggcaaccgtcccccgtgtaattgggacacgggagatgtccgttggcctcgatttgaacatttgcctggggagaaagtaacggtcgaggggggccgcgaggacgaggaacctgcgatcaacacgcagggcggggcgactgcacagccgcgtgcccaggctggtgatttggttggtgcattgtgcgcgagaaggcatcggaggcctgtgcgagggtcttccaggaattgtgttccctgtcttgaatataatctatgccccagggctacctgcgacaggatacgattcttggcgcgcagactgccagagtagcagtgctcactcctttcggagaacaagcactattaatttccacgctcattcgaatgttatgactgcgttacaaacattattttttattattcacttcattgac

SEQ ID NO: 7138 - DNA, 700 bp, Nannochloropsis_gaditana
gctcgacaacagaatgagacccagataactagcccccacgcgtttcgttgctctcattcttccacgggtctgtattgttttttaaagcacatgttagccaaagcacgggaggcgtgccatgaaagccacgaagatcgaggcccgctagtctgctttcaggatactcggcctccccccgtcacctctcaaatgtcatttcatcgttagcatgcatcgctacgtgcataataccgtgaaattcatgaggcatgaaccaagtaccagtccgacctttccattgtggcttgtaccgcgccaagattgcagtgcaagcggggcagcacggctttcctgaccgccacaggcgctctcagcgtatctttctcgcccacgccctcgccgagccctgtgcacagcgacctgcgggccatctccaagggcccacaacccgtgcaaagctacattaaatttcgatgtggggtattctctctgaaagttgctctcaaagaaagaagccacttctctaatgtcaccgttcaagcgaagtcagggtatttggatgctggattgtaacctcccgccttcgtgcgcgttgaactcacacaccagtactgtttctcatgtcagaaggtttaaacttatggccgcgtttaacaaatgtagggtgaaaaaactcatcaatgatcctaaagatatcgtcgaggaagcggtggaaggcatg

SEQ ID NO: 7139 - DNA, 700 bp, Nannochloropsis_gaditana
ttgaccacagcctctcccatgccgtgccccaggtcaatgaagcgcaatggcggacttcctgcacgcctgcgcggcatgtgacgagggagcacttcatcgaaaatagttttgtattttgacatggggatgttcatgtatggtaacgcattccctctgagcataggaatgactaagaagggcagggaacctagggtgagcaagcccacaacgcttgcagccccatacaggagcaaagggggctcagttggacgggggctcttcgattggctagggggcgagcattccatgcatgcaccggtacttctcaatcgtgctatatcctcaagatcagattttgttttccgattcaggactcttcattgctcctttcgaggcgtagcttcttctttttccatgaaagagatttagaagaagatgaggaggttaaaaagacgtaccggtaagaaacatgtgcctttgcgcaagagatagacatgagttgggtttttgaggaatcctcattcgatgttgcacttttatagacaccacgccacgatgaacgattgagagtgatgaaagtgacggggaaactagtcacccgtgggcaacgcgcttgctgtgggacgggataaagaagcatttgaccggaattccgagagatgggcgagcgcttcacgcggacactgcaacacatacgtacagcccgtccagcatggaaatg

SEQ ID NO: 7140 - DNA, 700 bp, Nannochloropsis_gaditana
caaatgagatccatgcattatttcattgctgagaactcgtagctcccaaaacgctctatggcatgtcctcgcagctgtgaagtcacgattttcacgcgtacgttgtgccttgctacctgtattttctgatgcatttcagtctctcatatattcccatcatttcaccttttccacatgacagaaaaatcgttcaagaatgtgtagacggtgagcatgtcggacggttgccatggccttacacgttcattttcgctctggcacaagatatcacccccttctgctgtgcgggcttcttcttatagtgggcacgtgtgtgaggcccagcgatgcttttacaggccagtcaagaaagtttttttgccaatggaaggaatgttggaaaacattgagccagccatgtagagggatggaaccagcggctgcaaccactaccgtctccggcactcccaccccagaggacttaatcgggcacgccactcgtctccaacctctggcaggcctggcctttttccccctagggctaatcgaacgtcgtttggagcatttgtacgctcttttccctcgtgaaaacgcgacatccatggtatgccgggtccccgatcttctgtgtgtcgagcccaacgaccttgctgctcgagtggcggagcgtcaggtccagttggcagcattacttccggcctgccgacctctacgtttgatg

SEQ ID NO: 7141 - DNA, 700 bp, Nannochloropsis_gaditana
aagagtgaatttggcagttgatactaagaccacagagaacacgggcggaatgatactcttccacgtccaagagcactttgggggccaaacgtttggcacaaagggtgccctattctcaaagccatcgacatcgaagctttgccatgcttttgaatgtggtaaggaaaatataggtggccgtggcggctgcgaggcactgagggaaagcaggctgatggaagcaactcgtaggatggagagcctccttctgtcacaagctgccccttccacaaaccagtgggaccaagcagagaggtaaaaccacaggcaacatgccaatcaaaataaaaccctgaagggaggagcgaaagcgagggtgctccggcacggcttccatgcgatcgaaaaagaagggaggggaggggctgggcgagggagggttagtggttgaggcgctcgcctgcaggggacgagcaaaaagtcacacaacgagaagatcgattaaagacaggtcccgcaacacgtcgagcagcaagggagcttggcctgacttgtcgggcacgagcatgcgtcgacgttgaccatgggggtttgattcttatttagtgctctttttgatcacgttgcggtggcaacactccgacgcacaggaaatttgagtgctacgacgtagctccttgcactgcaacccatcaagatttccctgttgttctccaccatg

SEQ ID NO: 7142 - DNA, 700 bp, Nannochloropsis_gaditana
cagctcgacctaggatgtcttcagtctccgaggcccaggactgccattgcaccacctgcccctgctcgactggtagcacacccgtaagctcaggagttactgctttcgctatcgcacgcgcgacagtattaggctccttaattatgtctccgtctgcgcgcagcacgaaatgctcctcatcctcccagtgcaccttgtgctcggtcgttgcatgagggaggcccgtggccagccacttaagcatacacggagaagctggcgccatcgagatctcgtgtcaaagctgtttccttaccttgtgcgtgtcaaaagaaatattcagagtcaagcttagagtttaaaacccgtcagatgtagcttcccaccattcgaccgccgagtttatggatgccacttcgacaggaggcatcacgtgacgcgtggatttgaagtgatgattcccgagcaattgtcatgaaaaacactggtcacactcttgaagacccgcgggattgaatggagtgccggcttctggagtcctgaagtaggagtcacgggcacagacgatggaggatgcccctactaggtagtaacctcccgggtcctggacggcctcgcaggcttttttcctgttcgcattcgagacgaacggcaaagaacccaagggaacacatgtacatccacaggtagagcaaagaagcattctaacacttgcagcatg

SEQ ID NO: 7143 - DNA, 700 bp, Nannochloropsis_gaditana
tgacgggagtttccataagtgaatgcggcggggactctggcagaagcttggaaccattgctgttgttcgttgttgccataaagatgcggatagcgtgctttttcgagctgcccacggcagaagggtcgctattaatcaacaaagcaggtgaaacggaagaaagagaggtggtacttccgagaacaggaaataaaaatgaagctgtgatataaccccaaaaagacctgttgtagtgcatcacgtatataaaaaggatgagtcgtttgcgttggcgatatcggcatgggccagaacggcagaatggtctgaggctggtttccagtccgcttgaacccgcgttgcgccccagagtaaccgcgccgccaggtgcttgcattgtcccacacataaaattgaaatttcgcacgaatggtagatagctttaagagtgctgtaaggcgccaagggcaacagtggtgttgtaatcgtttcgttcagtcggccaaccgtttcgtctcgcatcccctataacctctcgcccctgccacgccctgcgatggctccaacatagcgatggcttcatccccttggggtaccgtgcatgccattaaacaaggtggacgcgaaatcaaagcaaatttccaccgcacatcttcgtgcgatgcctctttcctccctttttgcatgtgttatatatgcactttatatcactctgttccta

SEQ ID NO: 7144 - DNA, 700 bp, Nannochloropsis_gaditana
ttgtcatgacgcgattgttggtgccggttttgctcacggctacgaacaagttttctccgtaggtcacacttctccattcgttgattgccgcagcagtttgactcgaccagctaatgccgtctgagctggtcatgaccagagtgccagaagtggcactggctacggcgacgaagagactacccccatacgtgacgtcccaccaagccgagtttgcagcggatgttctagacgtccagctctcgccatcgggacttgtcatgaccgcgttggttgccactgccacaaagagactgttgccgtatgtgaccgacctccaaaacgtctccaccgcgggcgtccgagcggtccatgtattcgcatctgcactggtgacgacccacggcgtttgaagcgcgacagcgacccaggttgaattgccgtaggcgacgccgctgtacgcgctggtagatgggacggtctgcgcctgagcccaatttgccccattgttattgctgtagtagatggatgaaggtgagccgacgcttacgtatgttccgtcgtggtagccaatggcaaccatgttcccagtgtttgtaaaaatagtgtcccacgatgatccaggaccaggcgccggcgtgggcgtgggagtaggcgagggagtgggcgtggcagtgggggaggcagtgggtgtggctgtcggcgacgtagtgggtgtggcagt

SEQ ID NO: 7145 - DNA, 700 bp, Nannochloropsis_gaditana
accggcatggaggcattcctttccgaccgctccaggctcgaggtgaactaggagcgagctgctggcgatggtactgacgcctcctcccacgccaattaccattgaagcaattgaaaaccgcatcaacaccaccgttaaccggcctatctttccaccatgttgcacaggtgtgtggtaagcagatagcagagaagggttcggagcacattggcgccatatcattcccgcagcactattggcagccccagcaagaacagggatgggaacactaaaatatccccgctcgaacaacgtcgtcggtctgatatctcaccatcttggcgtctgacggccttcttgctagcccgactggggatggacgatataccctcaggaatgcatggctccacgcccacacataacgcgtcctctggcacggcagcggcaggccctgcccctgaggttactgccccctttccgcccgtcctcgtgactggcgtagagatgaaaggcttgcacacaagcgccagtacctacaaaaggggccgggagcgggaggattctgggaccttttctcttccaaggggaggaccagaggcatcattgggcaagggatgcggggaggtggaatccattatcaatggacaggcgatcaaacgtttgcgcattgcaggatccgtcgacctgagtgagatcgtcgacctgcacgacccattcgatg

SEQ ID NO: 7146 - DNA, 700 bp, Nannochloropsis_gaditana
gatgcctatcacatccgcattcgattcacaagttaccaatcaaaagagaataccatggtttctcggtgtaccatttttgacccagctgtacacagactggtccatggatttttgggttggagaattcatcgaaaaacctcctgccgttttcttttcgaatttcgccaacggaaattcaacggattttcaacttgttagggaaattctcgctatgtacgagcatgacgagtcctgctaccatgcgttgtgtcccttaccatcgaaaatatatcttactggccttctgatatcttttcgcttgttgtcacattctgtatatcttaaaaaagaagcgcaatacagtttcgaaggcaggaacgaactcgctgacgcgcgctgcgaacacagcagcaagatgtcttcagcttcagcaaactacttttctacagctatattcggtcagagccaagagaaaagaactcttgttttgccagtcacttcacctgtgggggacctctcctcttcctcctgtccccccacaactcaggggagcgggtcgaaaaatgccaacgggctgccttcaaaatccgtcaattccacaccagacggcggcaattctgattttaaaaataaatatacaccttttcctcccacaacccattcaatttctccttcttcaccatctccacgctttcgggactggcttcggccatccaaaatg

SEQ ID NO: 7147 - DNA, 700 bp, Nannochloropsis_gaditana
tcattttttgtccgcccgtgtgctttgcgacggccaagcgatctgctcgcgagggtggtggagccacggctttcgcaaaagtgagtcttttcttcatttccatggagagttccctgcgctgtatcagtcataatgtcgagaatgatgccgttaatgcgtccagacggacgccggggtgcaaatgggtgctttgtgtcgtgacattgtgcctcggcaaatttaaaggctcggtgcgtcgcaagcatatgcattcgtcatcaaacgtagcgagcttggcatctgggcaataaatcgggcaaacggctccctttgtaccgcagcaacgcgatgggagaaatttgttgacacggaagtaacattactgcgagcctctgcaccgtaacctgttttaaaatgtcgttctctgtacttaaattccccttcctacttcctgtagcagcgtacgtgacctccactcgttttggagcttaaaaggaacgcagttttcacatccggcccactgcggcgacaagacagagggtgtacgcgagccaagacgagctagagtaaatatttgatacgagcgaccgaaaacaaggttcaaggcgcgggatctcttgtcactgcttcacggaaagcagcgcagccaagagaggaaacaaattgaagtcgggtactgcagctgctgcttatcaagtcaaaccaccaacagctacggatg

SEQ ID NO: 7148 - DNA, 700 bp, Nannochloropsis_gaditana
accaagccgtgggcaaaggtcgtctttcccgacgctggttgcccacagatggtgatcaggggcatcactattacaatgaaggatttgttagagaaggattatggtaagaaatttagaagaacgacagatagaaggttgttcaatacaaaaggacgaggtgaacgtggctccagagcgcgccatggaatccagcaatacccctcaataatcgaccaatcgcccgaagcacactttccaatgcatctaacaacgaattaaaaagtacagagaattcttcttaaagcaattcatacctgatagaggggagacaagacgtcgttaagaagaggacgcactggcctgccaggtaggggaataaaagagggatgatatttttagtcctcaacatacaccaacgcttaggccatggatgaaaacgcttaaagtaaaatgcaaagaaggtgatagactgcctgattggagagaatccgcagcttcgcgtgttaaaagacgggggaaagccatacctgcataagcacgttgctgatggctgtcgccttgcttgctggaagggaggaggttaaacgtggggaggaaataagagccatacacgacatatggcgtcaattggtagaaatcgtgacaataaaagcatattaccacgcaaaaattacagtattggagcgtatggcagctgcatcggtgtcggtcacgtgtgatg

SEQ ID NO: 7149 - DNA, 700 bp, Nannochloropsis_gaditana
tgaggggacgcaaagctacacatacgagtcatccaagcttgtctcctaaaaatggaaaaggcaactaccaaacttcgaggcacggaatgtaactgtaccaactatgctgctttcttagaccatggaaggaaaattttcacaaataaaagtcatcggacaatattaaatgttcctatttaagcgagataagcgctctcgctgcttaaagcctctcaggcaagcctgttcctccgccttcaaaatttcacctgtccgcaagtgccctgtccgccgccacatttgcgatacgtatccgaccaagaaggagggacgaagagtcggagacgagaaataatagtgcctgcctcgcgtcgggacgagactgtagggatttaggcagggattaccatcgacattttgtgaagtcctctttcgcagctttctaccttggctcataataccatattggataaacccttgacttcccttcggattctgaccatgctgccgcgagcacacgttggcacacatacatgacagagcgcaggagatgtcttggggacgaggaagagtgtgcacagcggtataaaccattgaaatttactatgcccattctccattatgagatcctgtagggataccgaagtatttcttattttacgcgtctcaaaaacatttttttttcttgggttcaccggtcacactttgaaagacacgcatg

SEQ ID NO: 7150 - DNA, 700 bp, Nannochloropsis_gaditana
ttttcagagtgctgtagctgtgactttgtccagtaggaaatagatacattgatcgcagcatgttcataccttcctcgatgaatcaaatcaggaaaatacataaaacgtattcatgatagatccaacggtataaagcaaagattgttatcctttgtatacgcgcttaggatcggaaagtcctccctcgtactcatattctttgtgaacagtcgcttttcatgctttcgccacagcatcatacccggaagtagatgccattgctgcgcctataccgtgctctgttcctgtcatttcctaccaccttctccacgctaaaacaatgacaaaaacacagtcctggtgtagaagagcttgactcttcaacgatgttctttcgtcgttgtatgacaagctgtccgacgggagccttcctttcatctccattacgatcgcgcagagaagttggcgatgcgcccatgtcatgccctcatgataccagaattaccctccgatgagttgctctgtagaaaatgaatataaaatgcaagtctataccacctttgctcatgttataggttactggaacgtttatcgatccctcgcgattttcgtcgagggcgtctagagctctgtttgggtacctcgctgctgtctgttgatcaaagacattcttgcaagactactactccactccaaaaaggacaagcctccgcaaactatg

SEQ ID NO: 7151 - DNA, 700 bp, Nannochloropsis_gaditana
  misc_feature (1)..(691): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggagg

SEQ ID NO: 7152 - DNA, 700 bp, Nannochloropsis_gaditana
taagcaagcaataagcaagcgtcgggtccggtatgaaggccacatagaggctcttgaaaggggacaaacaggaaaaataatgtcttctccttgaaaatctagaagggtctggatcacacaattaattgtaaattggtgatgttttttcatggcctgcgcagtctttctttggacaaatcgaaaagaaaataaagcatggcatgcttttaatcgagcatctcgcaacgcccattccgttcaagcccttcgacgtctccatctcaaccatgacaatatacggcctccatcggcgtgttcttaggcattttcgtccatatttatcaatgaacggcatcgcttctaaggctcaaaaggttcatgccgctccttgcaatcccaatgcgtgacaaacctcccgcctaggaagaaacaggcgccctacgcctcgcgaacgacggcgagtgaaatcaaatggaacccaaaacataaaaatggcaacctcttttcgcccgccaccacgtgtttcaagagaggtgcattcggggggaaaagtggcgccacagtggtcgtgtcgttagcacagtgtgggttaagaccatcggctcatcagcgctccaagtgagggcaaacgtgttcctgtcgccttcgtcttcctcgggcatgctccagtcaagaaggccgtttgacaaacacacaaatacacacatgcacccttgacagg

SEQ ID NO: 7153 - DNA, 700 bp, Nannochloropsis_gaditana
actccaacatcctgtgcgaaatgagggtggggattaatgggcggggtttggtacgaggataagtaccgtgactcatgcaacagccatgacaacagggtgacgagcaaatacaagcacacatacaaggggctatagaaagcagtttgtatagtgtattcaccacgaaaaccctttcatttttcgggacataaagaggggtatgccaacgacgggagcgacatgaagaacaagtatcccctgggagtagcagggggcaggagaaagtgtttttatgtaggccatgcatcgagaccgaggtagtttttccaggcgtattttgttcatcgtgttcttgtcatatggtcacggaagcctggtacacaaaagcgtatgcctgtccagtcaagagggcattttaagggcacgaacctcctcgacgcgacgagaaaaagcgagcgactcggaggagggagagacctgcctcctcctccatgctcccaagaggcccgcattgccatctcgatcaaatgtgatgacgatggaagctattgtgttggtggtcattcatgcatggatggtgtgacgcgttcaatggtgctgggttggcgtggcgttttacagttgaccctcttctcccccccttgaaggaccacggtaccttgctccgttctgagggacaaggccacctggaagaacgcaagtcgagccacctgcgggaatg

SEQ ID NO: 7154 - DNA, 700 bp, Nannochloropsis_gaditana
ccgggctttacagggctgctaaatgtgtgccgaggcatccgttgtcgagcgaagaaacatgcatgaaaggtggcccgacacgaccgcagaccacacacgccgcgggcacacagggcgcccgggaatgtacgcgagtgcacagatggtcatgcctgtatgcgtgtcggtggtgacgacgcgtctcatgcaagatcgatcgatgccccggagcgtggacgtgttggtgggttctggcccgcctcgcggggtatgagcatgaggttccaaggcgggagcgggagaatcccgtgcagagcgaagcgaggaagatgcgaggggcgcggggaggaggcggagggggagaatgacgagaaaggactcacaagggccggattgatgacgcggagaaggatgacgatgatggaaaaggaccctccttccccttctcggcgtcgcacctaggtccagggctcgccaaagaaaggggcccgcagacaacgcctcggaatgtgaagacttccctccgggtcatggtgttgcagggcgtgaaggatttccaaatgttttgtctcgcgtgtggaggttgaaaaggcagcagcgggaatgtgattggagctgaataccaacaagaggcgcacattacttttgttcctcaccacccgcttcctgcctttccacctcttcctactgcatgttttgatcctctcttcaggacagcatg

SEQ ID NO: 7155 - DNA, 700 bp, Nannochloropsis_gaditana
cgaggtccccgtccgtgtgttcaccggatggacgacggccctcagccgtctcctgcttcttgtgcgtcccggaagcagtggaggagaggaggttgccaccggcatagctgacacaaaagctgctcccggtcgatggaaccaacacttgagcttgttgccatcccgacgggacagggacctgtgcgatgggcatctgtacagaccctggggtgggtacagaagcgtcaaaaggtgggccgacatgagtgcatgttataggattcctcttttctgcggccgttaacgcaccaaaagtggatgctagaacaaacacaaattctgaatcccgatgacagtatgccgagggtaccaccgtcattgtctgcagtcacatgtcgggcactgcgagccatgtcaataaatagcaggcagcgaggatggctttggcagtgttagctttctgcgtgtagttgaggttgtagtaacgctgggcaggtagctttacctgtctgtggcttgccaaccagtcgcacagcaagacaaacccatgacacacttggtatttcttgatggaatgcgatttagtcatgtcacatgaatgccttcataaatcggtgcgcaatgacacgtgtcctcctggtttgcttatgtttccctcccagggcaaccttttcctttttcctcctttcgcgtcggctccgattacctggtggattggatg

SEQ ID NO: 7156 - DNA, 700 bp, Nannochloropsis_gaditana
gggggctcgcttgtagatcaacataaagggctgactcggcaaaggaccgcaacccacttccttttcttgccaagatgcgctcgcatgcacgccttgaacattggttgtgagaaaatggcaagctgaccttgaccgctggcacaattgcttggcctgtggtcgcctgtctcagtgcacgtgtcttccgatgcgcatgtgtttgtttcctgtgtgaaatattgcagtatctcggggtgttacaccgccccatttgtttcacctgtgataacatttcacgtgaaaatgaatttaccctgtaattttcactttagtaccaacttttatgcacaggaacgcaacaggttgtggacgacgtgtatgtagtgccatgcctaccccttcagcaccatcatctccctcgccccaacgacgcagctcccgcctggccgcagccgccgctgctacgtccacatcacctggcagaggggtcattgcagctgattcatcgtcactttggggctcggctggagcgagcgaggcttcctccacctcctcctgtccacccacctccacgtgccactcccccgctcccgcatgtagatattcccccaaagcttcgtccccacctttccccttccactccactcctccttcccttgcccttctttcgcgctccccaacgacgcgacacggctcgttaaaagtcagcggaaaccccatg

SEQ ID NO: 7157 - DNA, 700 bp, Nannochloropsis_gaditana
atctgcggggttgcggcgctgaaatcagtgtgttacggagcagacatgacactatacaagtatgtgttcaatagcttgcatgtgatgagtagaattcttgagaagcttggtttgtttgcctttaaacgacgcaatgggaagaacttgagagatgtgatgtccacctccttcctcgcggcatccacccccattatccttcaaaacaacagtcagcacatggtgccaggaaacgtccaataacttcaataagaagcggcagttgtcggcagtgggagtgtcagttgcttcggcatcgaatagccactaattgttccagacaagttccggtttgtgcttgagcacagacgtctgtgtatcaagcgtttcaaaaatggggcgcctcttcaaaaggtaaaatcgtgtgccattttaccccttcttgcttgcaccatgctccaattgtgcctttctttcctgccttcgtctgcatctaggtaccttgacgggcctcaaatctggtgctgctctcaatgctggacgcacctgtcgacgaatgaccaaataatatcaaagcaattcacgggccgtggaggccgtgcttttttgtacgataaagtgtgagtactttgtttggagattcagtgaaagatggctgatgtgccatgagatccgggcaagagcgtctgaggtgaattcgtcctccccacgtacagcatcaatg

SEQ ID NO: 7158 - DNA, 700 bp, Nannochloropsis_gaditana
taagtgccatcgtgtgaatatggtagctttgcaaattgcaggatttcaaatcaaataacgattttaaaaccaatataatgcctgacaaatggaagcacagcttattgattcgggaaagaggaaagtggcgttttagttgccgtcttggcaaccacctcccgtgtctctctccctccgccagcccggagaggagaaaggaatacacttcctgacgcgaattggagcattagagcctctgtgctggcggttcccttaaatcaagaacaataaggccttttcatggaaatcagatgtgtattcacggccacgtgctcggagcaatgtctcgcgtgccctccgaggattattctttagcagatcggaacagagatcctgatccactgtgccagccgccgcccatttctgtggtcataaaaaagccatttgggctccgcgacaagaccgcaaactctgacaattgtggccatttgtacattttacgggacattctggtctgcaatgcagtgtataaggtttgtttgagaccgaaattttggcacatctcggcgacgtgaaatgcgccggggcaacagcatcaggcaaggcagtagtcgctttctccacgcgtttttgctctccgacgtcgaaactgtgaccgtcccacacttccagtaataaaatctgtcatgaaattccttcgttactacacttcatactaggc

SEQ ID NO: 7159 - DNA, 700 bp, Nannochloropsis_gaditana
tgctactgtcatacaggccattggtaggagtctctccctctcgtgccaacaacttttgtgactctaggggtgcatcggacaccgtgcgtgaggaaggtggtggtttctgaccctcggggggggggtaccggaagcttgcagttagaccttcaataatatttcatgtacctttactttccctatgggtaccatcgatatgatggaagaagagggtgggactgccaatgactgttgtgacctttaggtttctcggccgactcatgtacgctcctacatagcatgtgaaaaaagaaactatcacgatcgagaccattgcacaggtcttgttcttttgtctctgaactccattgtgagttcacctcaggcatgcacatttccccccagggttgtttccctcacccttagagagcacgctgcatgttttgctttaatccttgctcagggtatggcacaacgattttaatcgtatgggccgtcgtcgccggcaccataagtggccaccgtgtcaggcgagacgtcaacaattcaccggggttgaccccattaaatgtttcatcttttttggagaatatgaatcatatgcatgtattgattgcaccctcatggtattttgccgtccctttgcaatgcacaggtgctccttgacgcaaatactgagaaagatacatagtctttgagcacaggactgccctgatacatg

SEQ ID NO: 7160 - DNA, 498 bp, Nannochloropsis_gaditana
acgaggggcctcatccggagtcagagcagcggagccacggccggcatgctggagaaggggacattggaggcctgtgagcgcgggcagcgggtccaaggcggggagggaccgggaggggcgaggccagaggaccggggccgtcggccgggggaggatgcgctgacaggtccagccctggatgccgccgcacaagaggaaacgcgtctgttgctcagcgttgagaagggagagatgatgcccctggtggcgccgggggggaagggtgcagggcaggcgccagggcgggaggggacggtcggcccgacaagttgcggtcagagggccctcgcccacctccctgccctccggcacgccttgccccacgtccacgcgggcttttggtccgcctacctgtccgtgcggacccagctcttgtcggccgtggaaagcgcgctggcaagggaagggacggagtacctgtattgcacagggcacagtttaggaggggctttggcgcaa

SEQ ID NO: 7161 - DNA, 700 bp, Nannochloropsis_gaditana
gggagaaaacattgcttgttggccacgttagtcaacagctcgtacctgtgtgtcaccaactggtcaggacatgcggatcatatataccattataatcgccgcttttgttctcgtcttctgtgagcgttcctcccccgcccgcagagtcttcgtacgtgccccagacctcagcccactttgcacgctgcaacggggtagtcaccgattgtcagctggtctcaagtgcggtcttttaagtcttgacgtaataacgggggcggctggaggcagggtcgtgaggaacagactctaaccctggattggggcggggattgcgagacttccaccgagggtatatatcctcccttgcatttgaccgcactttgtcctttggcgttcagatttctatccatatcatctgcaccctatccacctcaccgactttcgcttgcaactacactgttttcaacagattctcccgcgcctcccgcgcaaattttgcctttttggttgtgtcttcccggtgctgggcaattttatgatgctgcgcgtcggatccctcgtcccatgcgctgtccgacgacccgtgcaggctcacctttttgcactcagatcctcgcagcgagccttgagttccagtcttggcggcgggggcttgtcaaaactgcagacgtctggtgctgagggggagttacattccacgcacgagcaacatgctatg

SEQ ID NO: 7162 - DNA, 700 bp, Nannochloropsis_gaditana
cgttcgtcattcgctacttctgagttcattattggaggtgtgagtagaaagtcctttgcagcaaaatgccaacacgcgcaggcattttcgtatcgatggcttctcaatcggtctgtggtttgtaatgaggcctctggcgggttcgtgggctctggcccgcaatgggccatgccttggccgccaaggagcgggccctgacgtgcgcttgacggattccccgaggctctctcccgagcgaaccccccgacatgagccccgatcccaccacagaactctttatcagcctgtgcgcgccgcgacgtggctcaaaacgtggggtaaggcgctgtgcaccaagactggcatgataatcgtcggcgtgaccgcgcagtaagggattcgtccatccctagtgcgaatcagttggtgctcgaccctaactgccacaaggccggccattatcgcgcaggaagatcaaatcgtcgctggctgcggcaagtgtgtcgccggtagagaattatatttaccacattcagtctgtgtccttgcccaaagttgataacgtgtatctcaagttgtcatcgacgtatcggtcggtgaaagttaccctccactagcgaaatgtaatctttacgactaaaacttttcgtgtttgacgtgggctctcacttgcgtccaaatatctacacacagcttctcttctacgcggtggatatccatg

SEQ ID NO: 7163 - DNA, 700 bp, Nannochloropsis_gaditana
gccatccgaatcccgtcaggacatgaagaggataaactcgatcgacaccatttcatccgagttataccgtgtcttgcgtttttctcgactcctttgagagggaatacacttccattcagatcttcagtcaacgttattcaaagtggtgcccgctagagtgcgccagtctccgccttccagattgtcggtggcacctcccctcgcttgtcttccgaaggtttagccttcgccatgcttaccacgagacatgattttcagtaatttatattttacgtgtgttgcgtcttacaaagcgaatgtttgtgcactttttttcgagtgtacggatgctagcatctcttgcctacgacttgctgccctttgcagggttgtgaagcgcacaaggttcacttgcgtggcacggcacgggaacccctcattccttctatttcgccctcttcttttcgtcctcatttctcatccttttttcatcaccttgtggtggatagctgtggagtattatgcgactgactcgattgccggctgtggcaggagtgacaatttgactgaccggtttgaggcagtaccctccagtcacctgccaagtcaacattctagatcgcgcatcaagcaatttttttaaaatctgcctcacattttgtttttccatgcccacagttttcattttatcactgcacacagtttacaccccgtagacatg

SEQ ID NO: 7164 - DNA, 700 bp, Nannochloropsis_gaditana
tgagcatgtcttcgtatcatttggcgccatgattcaggaacagtggcgcacttgtgggcccaagagacgaacgtttaagtgaccgtgaggctgagcccaaaagcacgaaacgatggagcggactgcaggaaaaggtcccacttattgcacgatgtagcaaatcgccctctatatcaatcactcttccgaatgatccctgtggtgcaccctcacttcgtggtttgtgtttcctggcatgctgggacttcgaccttaaatgcatcgccgggatcaacgcgagcggctgagcgaagaatagtcggagaaccttcaggccccaccccgggtcatttttgtaaagtatacagtcgcgtgcggtgagatttgtctcgttgccacacatcaccgaaaagcgtgacacgcaagtcctgtcaccttttaaaatcggtgcgttggttaggcacatggtggacaagcttggagacgacacacgttgtccttctaagacttcttgtggtctcggatgtagtttgtcacccttttagagtgagtatgtctaaggctggagtggtgatttatctgtggtcctttatattcaatcatgcattattaatgtttcttttcagaaaagtgaccgacactcacaccctgtgtccttcatgcgcaggcgacgaaaactcttctccgcttacgtgaagctccgcgagtttaataaaacatg

SEQ ID NO: 7165 - DNA, 700 bp, Nannochloropsis_gaditana
tcggtggtgcagcccaaggcgactaaattgccaagagtgattggtcttgagcactccccatctgttccccctcccccctggggagggatactaaacacctccaagggcctgaccagtcggaaggagctatgttttcctccagcacaaaccgacatcacgcttcgataataattcatcgaaccgagtgggcgtatctaaatcctgtcgtacggccgccgagatagaccgctgatggcgcgatcgctcaggcgggaagaaataagagtctgcccgcgatgttctccggcgggcgcggtaaaaaaaaaaaaccttttacggcgtgcgatgcatctaattggagctacaatgcacgtgtccttcacaaaaacaggaggggatcgttgtgggaagccatcctcccatttctttcgcgaaatctgcacagcaaagtattgctttgtctcgccccgccttcccattttcttctcctgtcccagtccgccacgcctcttttccttctctctccttaaagggaaaaacgatgccgccggtagagcgctcaacatcttcttcctctgtcaagaaggagatagatggacgaaagcaggcctccttgttttccttttttcagaaaaaggagaagtccgatactccgtttccgccccctcgacctactccctccccagcaagcaagtctgttacccctctggctaaaaatatg

SEQ ID NO: 7166 - DNA, 700 bp, Nannochloropsis_gaditana
gcgtgtttggataagttggtatgccttcggatgtcagtcagaacgacttcaaaatactcgctaataagactgctgatcctccccacgatgagaaccaatctgccctcgaaaagtaccccatacaccgattgtttctctcttctcctccttcaccttcacgatagatatcttactaagatgagcataacatggatttgaaagaacttgttgttccccgcctattgttgcagttccttccaacgttgacctgagacagcgttaacctccccgctcctatggagtcataaccatccctctcccctactttccgacttccaacattttgacccgtccccacgttatccttgactctttttgacaggcatggaggggagtgtaaaggcacctccgcctcctttcccttccttgcctgatagagaaacttatgagcatcagccccctccaccagagggcgcaagccacgtcatgtccactcggaggcaagtaaaacctcgaaggcgcatgactccaagcatgctgtatgccgtagctttattctggtcgcgatgtgttttttacttgaccccttcatcgtgttcttcaccctcctttctccccccctcctggtctttctctcagcggcatgctggtgttcgggagcgtcgtactcgcagtggctggcaatgtcttggtggcccgccgatacgggaggcgagtcatg

SEQ ID NO: 7167 - DNA, 700 bp, Nannochloropsis_gaditana
  misc_feature (175)..(624): n is a, c, g, or t
gaagcatttatggggcgcgaagcgtttggctcggagagggatccactcgtcgtacttgcttggccatttgtggaaatgcacctggagagagcggggagaaccagagagcacgtgagagggagaaagggagggaaggagggagggagggagggagggagggaggaaaagcgccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccctcctctcagttctccccacgtacgtcctcgattgcatcgacgatgtgcagaccaaggcagagcttttgatg

SEQ ID NO: 7168 - DNA, 700 bp, Nannochloropsis_gaditana
gtgagtacgcgaccgtgctcacaaatgaagaaggaaaatcccgatttgccgcttatgttaccagttcagaggaagtcattgctgtcgttcctcccttttagtgttcacaacatcacataactaccactctccaatctatcgagttataacctacatctgtcccaatgagtcacaattcgacgtcgatacggcaggcccgaaaggataatcaaaggcttcgctcactaaatcacggcatatctcgcagatgaatgttctttcgttgcctctcatggtcccatcaaattgtaaaatgtgatcctcaaagtatgaatttccttactcagcctcaaagagttgtccattcccctacatgaaagccacgcaccccttcgtacaaaccgttgccgaccgttaccgagcccggagccaggacgtcacaaaatgtctccacaggcacacgaacgttcttctatgaatgcgcacttcgctgcgacaacgatgcgttagtgcaagttatacattgtacgggggaactgggctgcgcggagaaaaatgaaatgattagggaatacgaaacgtcttgcccattccgtctttccaatctcgcccaccaaaaggcatgtccgcaactttttacctttttttttccccaattattctattaaatcacgatataacagataatttctaagcagaaaggagaacatcatggacaatg

SEQ ID NO: 7169 - DNA, 393 bp, Nannochloropsis_gaditana
acaatttctccgtgcgctctgtttacccctcggagccaacctcgttcatgccctttgtttcctccctccctccctccctccctctctccccctcctcccaggcaacatcctcctcctcatgcagatgttctgggtgctgggctccgtcaccgtcgtagggatggcctggggggtcctcactgagcatggatggcgttacctgacgcgtgcgttcccgccctccctccctcccgccctccctccctcccgccctccgctttccatgcgccggtcgtgcttttccatatcatgcccgccctctttcccctcttactcgttcctcccattgcgtcgcctgtgccccgctctcatgtccctctccttgtcccgccctccttccctcccatagtcctg

SEQ ID NO: 7170 - DNA, 81 bp, Nannochloropsis_gaditana
acatcatactaggacctttcttgtatcgatttgcgaagtgaagacacaaaggcagctcttgcgctctacgtctacacgatg

SEQ ID NO: 7171 - DNA, 700 bp, Nannochloropsis_gaditana
tttggctgtgaagttgtgcgaactttcctgccttgtttgatcgttttgttgacttggggcgtccacagttgcaggaggaaaggccttatgcacttcatccccggtaagaatttcccgcataacatttacaagatcttatcttcacctaagcagacttagataaacctgttaatggctttgcttatggacttgtgtgctggatatccaattcatttttcaggatcaccgacgaacaaatttctcgacgactggcaagatattgttttttttaaataatccacacatatattttcgagaacaaccgaagaaaaattgctctggagctctttcgtaatgacaatatttagttgaagagatataagcctacaatcaaaacaatcatgcttctgacccttacctcccatgtgctcttgctcccacgcgttcgtatgtccaactcacaaatacaagatccacgaaaaaagagacattccatactgaaatacaaattttactcacccgccgcaaattgtatgcttattcagtgcgtcaaagtacccaaaatgtacctgaaaccatcaaattgatggcccatatccaacaaccccggacccaggacgctgcctccttcccggcggcgtgactagccatcactcatccttctcgagcaacttctcacatcaccaccgcaaccacatccacatatgacttgacagccatg

SEQ ID NO: 7172 - DNA, 700 bp, Nannochloropsis_gaditana
cgtcgtctcctgtctcccatcgacgtgctcctggccatcataggcaccaaggagatgaagagaaacctagagattttcatgcctgcgatgtgatacagaggatgagcaatgagacgggcgtaaccaggaaggggggttcgacacggttgcttcgactggccgtattgtgacggggggagacacggtggttatgtggtatgtgctctgaggtaacttgaacctttcccagatatccatgggaattacagtacctgacatctatctcttcacgccccaccgacgtcacacaaaggaacgcagagcaaaaatcagaatagatgcgctcgcacacattaaatctcagtgcccctttattacccagcgggggggggaaatggaagtagaaagcagcacgctttgagcgacgtcactgtttactaaccagctttgaaccctggcgcgcattatcccgcactgaccgtctcaccacattttggagccccctctcaccgtcttccacggacacgggatttttttccagtgtagggggttgagtgttgcggaggtatgctcgttgacgttgcatgtttgcatttcaggccgcgatgcctaacgtgtcggtcgtcatcatctttcgaattttattttgacaattttcgcctctcacgtcggagcattgcccaactaggatacacgcccaatttttgttaagggacaaatg

SEQ ID NO: 7173 - DNA, 700 bp, Nannochloropsis_gaditana
gggggtcactcctctttcatgtcccgagctcgcgcgattggcgaagaaagccgggctgacagcgaccggcgccagcacctccacgtaccttttgagcgacacttcctatagctggatggacgcgtacggccttcctcgcctctccctccggccctggctcttgattttagacggcagcacagggatggttttgagcgtgaagcgagacccaacgccaggaaccttgaacgatgccgtcatggaagtcgtgggggactggcggggtaaaaggtgacccaatggtgcccagaaggtggatgacagagtcgtaaaaagaaaatgcttgtacatgatcatcccaaagtcggtggggccttcacaagtattattttgcgggtgattggatagtcccctcgagtgtgcgggccgccactcgtccagcatgtccttcggttcggtgcatgctttgttttatactgggaggtgaacaaaattttatcgtcgcaacgactcgtactctatgaggccctagcttagcttaccggaagatcggaacaccaacctcctgcataacgcgattcccaaacacccctacaatattatcgtaggggagacatgaagtttaacgtatctgacatgtcttttgcatagtaattttaaagatttttatatcgtgggatgtcttggatccaacttacgggcaactttgccctctgtccac

SEQ ID NO: 7174 - DNA, 700 bp, Nannochloropsis_gaditana
  misc_feature (35)..(44): n is a, c, g, or t
accgggcctcgggagaaaagaaaaaaatggaatannnnnnnnnnctcatcctccccctggcaacataactgcaactcctgagatcaccacagtcagcgcccagcatgtggcgtggcgagcctccacgcatcttctttttggacgcgttgtgtcatgtgggttgttgtttcttctagggcatgcgttcggatctgtaactgaacagatatagacctcgttgaactaggaacggctcagatctttccgcctcccccctcgaccacaaaatgatcggcgcaccgcccacgcttatccagatccttctcctgttgttcatcctgacattcaccaccttccattccatacctatgaccacagttccgaagaagatgaagatcaccggccttgtcactctcttgagcgtggcttctgcacaaggtaagccctcacaggacgtggagagcccgtagtgtggagtgttttttggatcagttggaacaacgatcgcacacgaaccagaaaagccaatccatttccgcgaccattgccaagaggatcaacctctacatcttctcatcttttcgccctacaacacatcctgcacacagcctttgtcgctccctccttcttcaaggctccctctgcgggtgctatgacaggctctgctgccgtagccgagccggtctgcccttccacgagccgtcgcggcgtgatgacaatg

SEQ ID NO: 7175 - DNA, 700 bp, Nannochloropsis_gaditana
cacatgtatcaagaaggcgaatcctaagggtgctggctaggagtctgggtgctgggaacgatgcgaagctttcattttagaaggtgaacggttgaggctatttccgcatatttggtaatagcatttttaaaatattataagcatattctaaaaggaatcgtgctgttagaatttcggcgacttccacgccacgcctcacaaaagggctctcctcgagcgggcggatgggaaccgttagcaggctgagagggtacccggatgaacgagcgaagaggctggagccattcatggctcagaaaacaccccactgctcctggcacaaaaagacgtggtcgtgggagcctggttgtgtgcttattgcctttgcgaaaaaatggtacatttggagaatgtttggacggcagcggggagtggggttgggattgatgtgccagtcgttggtggtgatgagggtcgtgtggtagcggtaggagtgagggagccttcgctctcacagtcttggagtgtatgctcaaggagccatcagaatttcattaacatacatggatacgtgtacgaatgatatggtaacgatgtgtgatgagcacaggccctgatccttgaaagagtattaccactagctgtcatgctcacggccctcatataattctttcccatcccgccaaacgcttcacgctttgctctggcacagtcaaccatg

SEQ ID NO: 7176 - DNA, 700 bp, Nannochloropsis_gaditana
agctcgactcaagacagccaaaattgtcaagaaatgccccgcacaccacccacactacacaaacaacgaacgggtcttggggaagggcaaaatatcgcctggcctcctgcattaggacgggccatgggtgtgtacaagtcaatttgacagggacgacgacggaacgggcaataccaaaaaaagcgatcgcaagcgatgctctgcaaccaggcggctcaatcttcaaaaaccagacgcaccgcgcccgtgcctatgccatggggcccacgtcgtgtcgggacgtgacgcatggtggcatgggtggggtccgcgttgatgtgcatggtttaaatgatgtaggctgtggtgcatcgcatccttttacgagtcacgctgagttggggagttgaggacacacttgtcggcgctttgacggatgaaatgtgaaaggattatatccactccatctctgtcgcgagatttgaaacacgcgttcagagtcctttcatttcgtgtgcaaacagtgtcttggtcaaaatcggtatgaattggtaggaaaggccttgaagagcgcctgaagcctcttatcccctctacgctccttcatgcacgacagatgacggtcaaagaatgatacgaagagaaaaggaccaatcacctagtccatccgtttttcttgggctttcgttcctacttcctggtgatttagggtgagaggatg

SEQ ID NO: 7177 - DNA, 700 bp, Nannochloropsis_gaditana
acgtgacggagggcaaaattgggcttgttttctttataaatgttggggtggagggaggggaggcagcagttccaatggccgcttgcgatgtactacgtcgagtgaccttttcgtacatgcccacggctgcactagcacgtggcaggaggcattttgtcgccgtgcgtgggtaaggcatgcggtgagcctgtgatgcgtgtcataacgaagggtttagtggtgagaaatctgttcttttttcatcatcggtttatgatgaccggcggtaagctacttgctagtgaggtggagacgtctctacgcacgactgtaactttttcgattccatggtgtcgcaaacttcgcacgcatccctgaagcacaagattcgccacgaagtgaagccattgctacacacgtgtgggaatgaaccctctcgtggaatttgtaaaatgcgcggataaatttgctcgaaacgactgccagtagtgacggtcgcgatgaggaccccgagagccgccagcgctctatcttcagacagtcgtaaacacacgagaaaagcgcacatgccggataacctggcacccaccacgtccacatggcgtgccacaaggtcttttcgtaccatggtggaagttttgcggcgggttgtcttcactttttcccttttttcaaccctaccaaacaggagggtttgaattcctcactcttctcgatcatg

SEQ ID NO: 7178 - DNA, 700 bp, Nannochloropsis_gaditana
gctcccctatccggggcatgtgtgcgatgtggcggatggggtcgtcttcctcctcgtccaacataagtttaaacaatgtgacccagagagtagagtgatcaagtatacgaacgtgctggaaagtcaagcttttatggcccactgacgtgctgtgttgttgatgggtagattcgattccttcctgcacacttctactctttgccaaatagccaatcacagtacagtcggctcacaaagtcctagcatgcgtcgcctgcaacagagactttccatggcacgacacccggtgtaataattcggtcatcattgtgtaacaagtgctttcctgattcactgtgtccttgtcaagatttccgaccccttggctcttgattcttgcatgtgcgagcctgtaaaaaccatctcttggcagccgtcaaggcttgacgctgcatggtccccattcacactcggcgccaagccaataaatttgcgtgatgtacatcctaccaacaggtgtgaaaactcatactcgtccggttatctacgagacttaccgcgctctccacgtaagtgagaaagaacctcacatcgttccccctcgaatccttccgataatactatcacgcacatctcactcactgtcctcccaacgataaatacagcgccaaatatgaaagtggcattcttttccagtaaagactacgacaagaaattcatg

SEQ ID NO: 7179 - DNA, 700 bp, Nannochloropsis_gaditana
tcgttccaacttgactgaaaaccagtaacctatatttattttcgtaaatgtctaatgttttcagcgctctatgggtagatttactcccaaactatgcctcctctgacgaacggaagacggaggatatcagcactaggcgacccggatgttgggtgcctaccgagagtgggcaaagttggcgacccaggcaggagacgcgaagagaaaccagcgaaaaaaggcggccacccggtggaaatgggccgacagttgtattcgtcgatcgagcgctcgttggcaagacacgggcaatgaattcgtttacttgtatggtcttacaggggagcagtgaatgcatggcaaacgctgcacttacaatcgtggagattcaacgcccgaatccacagcggatgatatactgatcttatggtgcacccaggcggtgcggggggattgacaaaacagcgcccacgacaccgtccgcacgcctgcagcgtcgcatgtggcttgcttcttgcgttgccacgtgtcgagagggtctggacaggtgtggctgccagcggacgcgcgtcctggttccggtgggcatgcgttataacctccatccccccccttcattcaatcaaacccctctttatcaccccacgacccaccaggcactatgtaccgccgcatcacttccctcttctcctttctactgctcagcagccattgctggatg

SEQ ID NO: 7180 - DNA, 700 bp, Nannochloropsis_gaditana
aaagcataaacactgtttagcactcgaacttgtttttaacttttaaattgccttcaggacagggtaataaaaaaccaggggacttgttgttttatacaacacattataagctgtatctcaggaacagggaaaaagccatggcccccgatcaaagcgcaaagcaacctcgtgcgaccccaacaccccccctcggacgtcaaaacatctgcatgacaagtcaaacaaaaggcaccaatcgaaaaaaactgaaattgcatggagcatggccgtggaaggcggcatttagcagtcccgggaaaggacgtggcttgggaggagatcgttgtcgtttcgatctctgaggggagtttcgcgtcaggcgatttataaaaaaaacatgcctgagacacctctgtcctgctccggcaaatgtaacacacctgtccaacaaaaattgccacgcttctgtctattgtgcgtgcttttcatgtggtgggaaacccgccctccgccccgcggccgctaagctcgcactttcgctccccccgctctcccaatatccacaaaatccagtcttgcttctttttctctgacacgcccctcaccgactcgtttgaaggccgcacgtgccgtcccagcacggaagatccttgagacgggaagattcacgccgcattgttctcacggacccattcttccagcatacccgcagatccgtatg

SEQ ID NO: 7181 - DNA, 700 bp, Nannochloropsis_gaditana
tgcggtttagcgacaaagcttggcgagactttccccgaggggtaatagctggaactgtaccaattgcgaagttttctgcggtctcactcgcatcataatactcaccgcaggaaaaatgcataatgacgcgcgctccgagctggaggaggtgagtcggagggtggttgtgttcataaaggaatgaatggcataggcgtagtgcgtccttagggtggggaggtctcggcgagcttgcagcacctggaacaagtacccaacaccctcttgcgtcaccaaaaccggacagctcattaaagaacgtgataatcttgagaccgaggctgcagtcatcaaggatttcctaacttcacctgggcctggcggggctgcccccccgggcttgggcggagtgccgcttgtggacgcagagggatttccaagagcggatatcgatgtttgggatgtacgggtgaaacgaaatcgcctggcatgcatcgacacagatcatgcagagctcatgaaacggatcgaggagctggttcaacggcttcatcaggaggccaagaccagcgcgggagtgcgaggaatgagcaacaattggagcacaagtagcagcactgggagggatattggggctctatcatacacccgcacggaagaatctcaagtcgagacagttcctaagcctaccgcatgtatggaggtggaaaacaggtccatg

SEQ ID NO: 7182 - DNA, 700 bp, Nannochloropsis_gaditana
tccggcaggagcggacgaaatagccttggctgctgaaatatccttctatgtcgcgggcgtaggactcgttgcgcgtggccaagaaaaggacggggaagtcgggttgggaatgataaatttcgtccgcccgccaggtaagacccgcatgcaaacaggtctttgtacaagaagatgggcatggacgcaaagaaatgacaaaggagaagcaatgggtaggaaagaggaggaggaggaggaggtaggggaggaaggctgtacaagggataacgcgtccacaaatttgaaccgacgacggcatggacgtcaactttccgagtgaagacaagaggtaggccgcatctttgtcatggcatgtttcttacgcctgtcatggtaatcaccagcaaggaataagcgtccgggtttgggaaaggaggctgtatcgagtggaacatgaatcgccacggccgacgacgtcatactccggtgaaaggctggcctatgcccgtgcatggtgcgtcggacgagcagtatgtgcaccaaggcatgtcgtggatagtcgttttttgttgtgagacgacaggtttgactcttcgctctcgtaaaagttttggccggacagctatcaaagacacgatagtttacctccccacccccctttccgctaaaccacacaggcagtaggcttctgctttctttttcgatcggacgtcgagagatg

SEQ ID NO: 7183 - DNA, 700 bp, Nannochloropsis_gaditana
tatctttcgatcttgcacgtccatcaaataggtaaatgcggcgttcgcacgacatctgaatgtcagcaacagtaattgtcattctataatctgacagaccattcgaaattcctaagcgatggtatgagcggtaaatttctcactgttcatccagacaaatctaagagagggcatgaagccgagagcagagcaaatcacggagagatggattggagcgtaagtctacctcctcactatctattcgttcccaagatcatcgattttgaaacaacctcgtggtacaccgacaccttctcctatcatgggacttcaccacccacgtacagtgcttcagctccacgtagcgccacgtctcaagtttccaactgtaagtttgaaaaaacgttacaagggcagaggcacgcgccacgcccttgtctgcggcatctggcccaagtggattgcccttatgctccgtaaaaaggcgccgttaacggcacaaacatcaatcttggtgcggaaaatatacaaaaatgatagtcaataccttgaaatttcatttaaatggagcgtgatactccatcaacgatttatgatggaggaagctcaatcgcaagcacgtaccatgaagctctctttccaatcattctcctctcactacaatgaaccagggagcgagagttttttttcgtctccattttttacaagataccatgcgatg

SEQ ID NO: 7184 - DNA, 700 bp, Nannochloropsis_gaditana
gggcctgattccgtccgagtcgagcgaggacccaccctcccacgcgcaggctagcaagcaagaaacgcaagagacggaaaagcccgcctctttagtcgtggcacccaggtcggcgaccggcacgcacgcccccaccctcggtacaggcctcgaccctcccaacacagcggccgctgctcccgaccccttgcctaccgccacccctccctccagccgtgctcctcttcgctccctttccatgggtgggaagccccgtgtccctaactctgcctctcgccctccctctcgcccgccctccatgcccctcactgggaatgaccgcttctatcaccctgccctgcggcgcagcggcagcaggagcctaactgcaattccaagcttgggattaagcggaagcagaggcggcaggggcctcgagtcggggggactggacgcgtccctctcctcttcctccaccccccagcacgtccccaccctgggagcgctcaaggcgcattttacgtcctcgacctcctccttctccgcctctttctccggccgtcgacgcgcctccttcaccgcggggacaatggggggccgccacaaccctccccccctgacacggcgcctgagcttgcaagagttgttgcaacctcgcgaagactattcctaccgcgccgacccctctgctcccaccctcccgccccgtctcctgcccatg

SEQ ID NO: 7185 - DNA, 700 bp, Nannochloropsis_gaditana
tgattgccccctctgcgtgtcaacaggaatctcttcgtggccatagatggacttgacccgggcgagcgttgcagcaatgcgtcctttgctcctgaccactttctccgtttccaattcccattcctctgccaacgcatgaatgcttctcaacccgtcgacaactttctcacgcgaagcaccctgaaacatcaaacgcggacgagttccgcgagaagaggtggaggaaaggtcaaggtgcttgcggaacattccatctcaagttgcacttcagcccgtcactcaccgcatctatcaaagcacccaaaagcatgtcacccgcaacgccgcatttgcagtccaagaatgccaccctcgtgctcatctcttcttcttcttaagctctgtgatttgttcgctgtggaaaaggaaaggcgggttgactgttgtgttggtcttttcgcgacagaaggaaccccctctccgcccactgggacggggcagacggcgatggggatgaacgcccttgcttgacttctgatttaatcttcaccgtaccaacagggacatccgtggcaatatatggggccacagtcaaaattgttgctgtttttacgcccatgaagtcgtacgggtcagggaggacgaaatttgtctcaaaattaagccactccgggtctgattgcagacagtaggaggttatccataaaccaatttagtcatg

SEQ ID NO: 7186 - DNA, 387 bp, Nannochloropsis_gaditana
gagggagcgggtgtcggagcgcaagtggctgatcgcttgagttttgcatagccctccctctttcctttctctttcccgccggtcctttctcttccctcacccaagaatttgagtatgccactactcagaatcaacccttggcgaccccacgtccaagttcttcttttctttccctctgttcggtcccttgtcacgtgcccgcactctttctcccctcttctttcgccctccctctccccaacacactcctgggaataagcactttctcccctcttgtttcttcctccttctccctaggacacttctatgaataagctcgtcatcaccacgctggaatccaccttccacctttggcggctgcggggtcgcgacccgtcggagacgatg

SEQ ID NO: 7187 - DNA, 613 bp, Nannochloropsis_gaditana
cactgcagatctcatctcgagaattcctgaaaaggtcctaaacccatcttgtttcgtgagggtgggttcatcgacttacaagattaaccatgcgcaagaatgaagcaggagctgagatgcctccacaaagtattgtcatcgcttgtgaaatgtggccatgttacaggtgtaagcgcagtggtcactacaggtacaacgtcattgtttgacgctacagtacgaatgccttcttttcggacacccgcactccaagtgaccgtgaaatggattcggattagaacaagcacgtggtttacggaggttggaaacattactctgtacactattgatcgagtaggcggtgatgcgaataaaccaaaaacgctgcggataacccaacatccaattcaattcttcagtacaactaatattctctctgagaataaaaaccaaacgattcagccaagaatcttgtactaagataaccaatacgacagactaccaaagacactcgtcgacgccagtcctgctgtcatatagtgatataacatacaaaatgattaggtggacgcaaaccatgacatgacacaatagagatcagcacatcgtagtacagactgtagaacccataatg

SEQ ID NO: 7188 - DNA, 700 bp, Nannochloropsis_gaditana
tccgcctgcaagtcataccgggtgtctgtggtcatgcttcaccgatccgcccatgagttccagcatctgcgccttgtgcctctctgcttcagtctcccaaacagttggtggaatgtaagtaatgccctctggctctatcccccacaagcgctggacagtgccgcggtcgagaagtaatggacgcgagataaaaggggggcgagtgaaagtaccctccataggagaggaagcatgaggcttcgatgctgcggcaaggcagccaaatgagagcacgaccgtgaggctgtaggagcagtggtcttggaaagactacatcgggcggccagagtttgagaagacatgtggagagtctgaagcaagaacgcaaatgcggctacttctagtagtactggtacgtggtggtagggccccgtcctcgcgcctctgcccttcatctgcctctatctaccacaaaaaataccatagcacgagttgcatccctaatggcctgtatgtattgcatcggaaggtgtggggtcgttagacagggtacagaacacaaggaatggcggaacactgctctggttaaagagagtggagcacttgcgaggcgagatcatatacttgaaggacagaggaagcttgccctgcctgaagacaaataaaatacttgaaagacgcggcaactcattacatttacacgtccacagatcttcgaatg

SEQ ID NO: 7189 - DNA, 700 bp, Nannochloropsis_gaditana
cacagcggacaggtggggcgggcgagcagaacaggcaaaaaagaagcccatgcccacccaggtgtccatttctagcctttaactgtacagatacatgttgacacaacactcgtatggccacagggagcaaatatcaggtaccatcaagactgtgtcttttcgaatgaaccctcccagagtctcctccccaccctctcccccgccgtgcgaagaaacgccttttgcacattcgcctccccgttcccagattgatcgaccggaaagcattgcctacacaccgcacgcctggtgccgtcgtcgacgctgccatctccagggtggaattctcgtcctttggttggttgtggtcatcttaatcgcagtggattactcaccagcaggccatcggcacgtggctcgagtactttccactttcttggaatgggtaggccgccaccctctcagaggggccatggcatttgcagccgtctacgccttgagcgtcgttttcttcgtgcctggagccgctttgaccctggggggggggtttctcttcggacaagcactgggcgtggggcccggtacggtctttgcctcgctcgcagtctttgtgggggcgagtgcgggggccgtggccgcattcagcctcggccgatggcttttgcatgaaacagcccagtccacgctgaaccggtacactatactacgggccttggacgcc

SEQ ID NO: 7190 - DNA, 700 bp, Nannochloropsis_gaditana
ctgtgtgatgataggcgtacagtgtgcgtaagattcttatcgattggacaggagaaggacgtcacggaatgtgtttggtgcaaaagaaagggccatggcttcccacatgaggtaggcctagccagggagatgacccgaggcccgcagccaagcattcccttccccttcaactttgccgatataattacgtgtcatttctcagagacgaatcggtgtgcagcataaggatgaaggcatcaaggctgtcccctacggccctcgcctcgaccctaacactcctttctcgtgctcagagccatcgctttcctcgcctcccctcccctactgttatcaaccaacgcacatgcctgtctcagcggtcctaaattacccccaccttcttggccacgaacgctccgcagctctcctattcctctgtaccactctatgtcactctttgtcagcagtcaaggggatgtgggttgtattggttgcctggtacaattcctagagaacagcaggtcatgaagacagtacggatggctgttgatgcgtaatgtttctgtacatagctcccgtttctagtctaccctggtccgaagaaagcccctgcacatatgcacccgtacaaacatgaaatccgtgctcgcacaccgccacaaccttgttgctcatgttttacacatatgatcgaccgcactgacaaattcacagagaaatg

SEQ ID NO: 7191 - DNA, 700 bp, Nannochloropsis_gaditana
tcctagtctcgccattcgccctgcatggtcgatttcgaaccaccccccggcatgtcccacgcgcagtggagttgcgtggtgcgaggaaactctcctgatttcactcctgatgcatgatttttaaaagcatgtgacatatctgacggcaggggctccgcggggatgaagggctggtagggcctgtctgtgcgagaggcagtgcttttcctatttttccggggtgtctcccgtttcaatcgacctccaaatctgatacgcactgaaaagcaaaggacgtccgcggaattcgtagtcggtcatttcccttgtctgtgggcttttgtgtcgctgtgggtgttgcctttccgaattggttatccacttcagaccccgatcacccctccaaccctcaggatactgaggtcgagcctattgggtgttgagaagtcaattctcacaccattcgtgatccatacacaccgcagcaggtaacaaaaattgtcaaaattctgcactctgttggcttcgaacagaatttcggacatcgatatagaggaggggcacccgacacgagggtaagggagggtctgcggagttcgcggcggggaaacgaaatttcctccgtgctctgctccggtactttcctttttgcgcggttcttgggcgtcctaggccaagcggcgagagcaaaccacaccttgacaagtgcgtgaacttgatg

SEQ ID NO: 7192 - DNA, 700 bp, Nannochloropsis_gaditana
tagatcctcgccagactgtctcgcttaccttgaggacgtgttcaacgacacgccttgatcctgggcctcgggaagagaaaaagtacatgactgtggaagaaacggggttcagtacgtgcccgcaatcatcgatttcgacacgctgccgaccctaggctcagaaatgcccagtatagtatttatagcagcatgacaaagtgaatatgcctgtaattgttacagaactacgaggcgggggggggaggtcggcaagcagcctaacagaacgcgtctaattgctgcgtcttcgtcactgcccggcaaaatacgcgcaccagagccgcaaagtagtggccagatgtctatgtcttggctcctgtaatcctcgcacgacacacctgccattccgggttcccaccatgctgctgcccgttctgttctttgccctcgccgagcctcagtatcaaagagacagcgaggcttgatgggatgaggcattatacgacacatcttcaccccacgacgaggggggatggacggtggatgtggcccgttctcgtgtcatgtactagaggagctgaatggtgtgcacggtaatgtcggcacgttaatattggcggaccacgcacatagcaggctcatctacatcggcgcagtgtgaagaaacggcaagctctcagaggaaagcgactgctacgtaagaggtgaagatagaggcatg

SEQ ID NO: 7193 - DNA, 700 bp, Nannochloropsis_gaditana
  misc_feature (462)..(471): n is a, c, g, or t
atgtggtcgtccttctggaaatttctagaagccacggctggccttttccatttttccacctggtcctcccgagtggccacgccaagagatgtctaaccacgtcttgccctccctccttccctccctccctcagtgatgaacaacagctggttccgtctcaaaacttccctccatcggaacacgcagcaacaacttgtcctccacgtccatcaccccgcccccatcggctccttaggttggatggaaaaaggcacgggcgttacggcgatggcccctgggaaagagcaagggggtgcgcagcacgtggaggagaaatcgatcccagtccgagaaatacgcaaggacctgcccgcaatctcttcgacggagctcgcgaggcacaaatccaggtggatagcagggtggcagggggagggaaggagggactgagggccttgcactggatgtagcttcgtcggcttnnnnnnnnnnttgtgtgacgcccgccttccaatctgccacgcaagggaggtgcttcaaagcgatgtctgccctatttcggcctggttttcggattctgtcgagatctttttctgattccctcccttgcgcataccacccggtggacaggacggactgttggatcgcgattaaaggcctcgtttacaatgtgacgccctacctgaaagagcacccgggaggtgtgggtgccatcgtcatg

SEQ ID NO: 7194 - DNA, 700 bp, Nannochloropsis_gaditana
  misc_feature (657)..(666): n is a, c, g, or t
cgcacttaccagagctcccgagtgtcatagatttccagaggatcaatgcccgccagggggtttcctactacattccgtacattgtcgagcccactgctgtagcagcccaggccccgcgcgagcaagccggtgatgatctcactggtgtcttccagctgtgtcagggagggtgggacagtgggggaaaagggtgcgtgcggtcattggctttaatgttttatttataaaagggggaagaagtgtggcccgacaatgcgtgggatagctcctcctcgaggggcgccgtgcctcttgtcgtcgggtttttccaaaaattaaatctaggctaggtgacctctgtctcgtgaatcgcaggtcttctcccccctcgctttcttcccttccccttgccccctacttgctcggccgcccacctcccttccttctcccgccccgttcgacctaccttcagtccgcgcagctgcaaattctgccgcgtggtgatgtccaccacggcctcgtaatcctctccatacttggccatcgcctccgcgatgaagaaaagctgctccgaggtgaccactccgttgggaattcgcatcctattccccaaagaaaaaaggacggcgtcaagacaagctacatatctgtattcttcctgccaacgtcgtggggacnnnnnnnnnntttccctccttccagcaccgccatcaatgacatg

SEQ ID NO: 7195 - DNA, 700 bp, Nannochloropsis_gaditana
tccttttcgcacgagggcaacgtttctcgcaagggagcctatctgcaccgattgaggatcgccgtcgatctatgcacgctgagcataataatgcgacgactttcttgccttctacagatcacacaagtcggactctccgagggattttcaccccgaaagattgctatgaatattgctcgctggaggagaatgattttgtgcctttcttctttaattggaacactgtgacaagtcagtgcttctgctgcgaagatgtgtgtaccccttttatctttgatcccgcatatgacatgtacgaggtgaatctcgctgccaccgcggcacctacttcagctccgacgacttccacaccgggtccagcacactctgcccctatactggtccctacgcccgttggccgagacgttattataaaaatcggaaatggtgcagatgacaccacaggtgggagctttcagtttgcaaatattatcagcccaggcatcacggtcagtaaacttgataagatgatcgtgaggaaggaatttggatagaaggagagctcaaatctccctaaagcaaaaaattatgatttttgcaatcatatttgaaagatctaactacccttgtattcgatttccacctttatccttgtacacataggccgtcgtaaacgtggttccagatgcctctgatcctttatttgtgccgcccagcggtt

SEQ ID NO: 7196 - DNA, 700 bp, Nannochloropsis_gaditana
gaccctgcaacctgtgatttgtacggaatgatcaagcgctgaaaacaagattgttttcgagtaagagtagtatcataataacataagatgccagaatcggatccaaactgaccgccactgtcataagtcacctggaggaacatcgaaaagcagagttcgcaggcatgcttcaggggggaaggagttcaaagtattgcgagcggtaacgtggtttcacaggaatctgtcgcgaagtagtgaatattcaaccctgtaaccactcttcatgggtccactggctctcgggctatctcaacccttcttagggagttaagatgtggagtcggctgatagattcgacacgaatatgcatcggacatgttttaaaaaaaacgaatcgccaaaagtcctagacgaaacgttcgttcgattctaataccagagtggacggtttaccatttttgacagggtgcttatgccactgcctctacatgatgcatcgagatctagagcttatatgggtgctgaagattcactttcattaaggatatgagaagtgtctctcggaaaaaaaacatcgggcttttcaccgtacagccgttttttcgttaacggtcgaatgttgccatggttaagagcatacacttaaggattctcatgccgatggttcaataaatgccttgcgatctattcgtattttttaaacttgcaggtaaccatg

SEQ ID NO: 7197 - DNA, 700 bp, Nannochloropsis_gaditana
attacaataggcataagtagtgtagatcaaaacgtgctgtcttgtcaaagcatgggcgtaatgatgccttcccagctctttgaggcaattgatgtggctaaaggagcagcaaaggctcttatggcatttataagaatgacctttgaggagcacagtcggcacatttccaaagaaaaatagtttgcaggcactatgcaagtgtgtctcgttctacatttacaaagaggggacaatgaatcacctactttggttatgcattttgtcgccccacatccgggtcgcctagtgttgacatcctccgtcttcaacgtttgaacagccgaaattgccatattattgaatgtgtttacatcatgacttgcctcgcactcgaagtttgctttatattgtgttttgcttgatactagcatttctcactctcgcactgttcttgtatctttaaggcgcatgaaggcgcgaagccttccccccgcacgccatcttgaagcgattttgagcgacggctgtattcgtttgaaattcatggatggccaccaccatggccggtgctgcactgatttgtaattatctcctctacgctacaggtgcaatgccatgttgtaatactgacgtcgtgactgcattcagcagcagcagcattgccacaaatgcgacgctgcgcatcaagaccaaggcgggaacggaggaaacggtggagatg

SEQ ID NO: 7198 - DNA, 700 bp, Nannochloropsis_gaditana
caaagctgctgcaagttgtgcctctcttggaagattatacgtggaattctgtgataaaacgtgggtacgatgggcgaaaaggttttaaatcgagcacaagtgggaggtcggaggacctgtgcaaccctgggacgggataaattcatgcgtagtgtccgagtcctgatcaacattagtcagattgagcatgatgcatttagttgtcgccattttcacggtgtgagtgctattaccgcgatacctccagactttacaaatttcaagttttccttttcgagagatagcagactgagggaggaggttgtcctgtgcctgcgcctataccttgcaaacatgaaataatccagagcacccaacgtcagactcttgaggggcatcttcggaacaagaaatatgtactcggttttaattcatgccatttttataggtccaaggcgcattcagacgccacaaaccctgtgcaccagagcactgcaggggagcaggcgaagtcaagtggtgctcgcccactacgatcgaatgatttcctcctgacaaaaataaagcaggtccttgtctcaaggacacaacaagaatttaacccaaacaaccatgagttgtcgttgtacattgccactgtcatggaggacccgaaaggacaaaggaagagtgccctgaccgtactgtccacgtcacccttcccttcccctgtacctttaca

SEQ ID NO: 7199 - DNA, 700 bp, Nannochloropsis_gaditana
caccattgaccgggccgccagtccaggcctgagggagggctgggaggcatccgcgacgaaaatgtggagtccgtgcctttctgggaaataaaattgcaaagtaatcaccaaccgtcttgtcttttccgacccgaattttgccttgaacgactgtcgcttcctctaccctgtggcccatttgggcatctctgttccttatacctcttcccttgagcttgtgcacttaacaccaatgtgcaaatgcctcttggggaaggccagcattaagaggcatccattacttttatcagaactgatttgcagcgatttctaccggaattttgcggatggagacaacataagcatgtgtgtctagtcgtttttattagtggggggtgtggtaaggaaaatcgctttttcccctgatatccctcagacacctcaatcctgtgagggtggaagcgcaccacagactcggattcccggcgtttgtgtggtcgtcacgggtgttgcaggtctggaaaggggatagacagaatgtggatgctacgagcacggtcgcattctcttttcaggaggccagcgggttggagggtgaaccatcgcacgagagaaaaggcaaggagaggctggaggaggcgaaatgcgtctacagcctttcaagtccccttttctagtgtccacttccgtgctcatccttccccatattcacgacaggatg

SEQ ID NO: 7200 - DNA, 700 bp, Nannochloropsis_gaditana
  misc_feature (1)..(97): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtaaatgcggctgctggtagtcatggtgttcctccgaaccccccacgtcgcttccatggtgattgacgaagagggcatgaccatggggaggtggcactgagaaagttgaagtcgcgaccgtagccatgatcgcccttgtccccaaggtccacccagacctgtggatgtcgtatacgtagtttttatccacgcagctggttgggaaaagagaaggaaagagccagcggccccaagaaaaaatcacgcgtcggaaaaaagggccgctacagaagggggctttttctgttagcctccttgctcccgagatcccctacaacgcgcacaccgcacacacagccatcacgcaacgcagccaaaagcacacggccagcgcccggcgtctagttttactctataggtgaacgtgccatacgaagacgggatcttcaagcgctagccttggggtgtgtcttttatgacaccacagagagggcatcgggttgggcgatgaactcagcgacgcacgtactcgtggaaaaaaggggcgaaacgccacccctcaaccccctcgccctgcgtactggcaccatacatcacagggagacgcgcacatctgccatg

SEQ ID NO: 7201 - DNA, 700 bp, Nannochloropsis_gaditana
actctgatttgtacggtgccctgctttcttttatccaataggccaaagtattctcaccaattgtgcaagaccatagagaattgtagcacgttcacatacatttgtgcgccgttcgaaatcccgggtgtgtccaatgcaaatggccctgttttgttgctccggatgatggaaggcactagcaacgcaactagcaattagtgttattagttgtgtatccacgctttgggcaagtagctgatgtcaaaattttcactaaaaatcacaccttgtaccactacaagcagggttatggtttttggtgctaaacacacaccgtttcattccctgtcgtacttgacaggcaacgtcaactgagaaggagccttgggcgaaatatgccactgcttgcgtgcttcgctactatccatcacgcccaatagcaaaattacgactattaaatgtgatgcatcctccctacaaaaagatccccatccgcttggaccatggaggcaacgtcctcctttccctctgcgagctcacgccgatggagcgctggcaaggttatggtgtctttccaaccaaagtggtcttgcacgtgatcctcttggtgcttaccacagccgccgtattacacgacgccgcacgctggagcccttaccgtctcgcaagtcaagcatctgcgtgtcattttttcgctcccgctccctgtgcagccaagatg

SEQ ID NO: 7202 - DNA, 700 bp, Nannochloropsis_gaditana
ctcacctgcgctgcgctctcgcttcaccgaaatttgggtccctcctttgcgggcgagagcagacgtttcatccgtggttctctcggttctggcccctccctccctccctccctcccttcctccatccctccccgtttctttggagttgaaagcccttgtggacccgatgcttgactttgtcgactggttgcgagaggggggagaaaaaggggcagataaggggcgagcgtcgtccttggccgtgccggctatttcgctcagagacctcctgacctgggcgagctttgtgacgacgacgactgaccaaaggacacggcatcgcgaagcgagtggcagcatggagaggcttccatgcctgactgtcgccgaggccttcctgcacggcgcagaactcgtttttttggatgggctagggctgggagcttcctcgtcctcctcctcattgcacgcccttcgcacccgtgcgcgaggccacctactcggcctgcttcgctcttccctctccccagacatccttgcaaccagcttaccctccgcgcagggcgagagcccccccccactcgcctccgacgccagccatttcgggatgggtccctttttaatacctcgagggcccctccccttggtcgaccctcgcttcgttttgaccgcccccacgactgccctgaacctccatcggatcctgcgcgccttacaaatg

SEQ ID NO: 7203 - DNA, 700 bp, Nannochloropsis_gaditana
  misc_feature (180)..(189): n is a, c, g, or t
aggagggggagggagggacggagggagggctggtgcggcaggagggagggaaaagggcccacaagccgcgggtgaaggggggaagaggccgaagcggggggccgggcgtgtcgaaggagctgcctatcgccgaggaggatgggctccgtctgggtcaccccctccctcccccttcctccnnnnnnnnnntacttacgctgtaggcagttggcagagagcgtcttggtggacggtgtggggcaaaggcctcggtactccctgaggaccttgacccgggccttggcagctgcacgcgcactcacagccgccccacagcatttgacccctgttcgcgcacttttggaaggattcgcgttagcgtttgagacacagcttcaagacgcttctcgaccgctcttgcgtaaagagctcctggctgccctaaccagggcttcgggcgcctcttcgcgcaaaatacctccgggattggccgagaaagagttagatcaacccgcgcgtccacccccctcccccgattcctctgtctctccttcttgggtactggtctcaggacctttctggctccctagcggccctctacccctccgcgattggaaccaagaggagggcagtggcggtcctggtaccaagcgtttcattctcaccccctccgcccgcttggccttgcgggggctggcccgcgcagtagccggaggccatg

SEQ ID NO: 7204 - DNA, 700 bp, Nannochloropsis_gaditana
cgtaaggaagagagatcgcagcagaggagggaggaagcggatggtgcagctccacgcatgctcgtgacggcgacaaaaacagcgttcttgtttttggaattgccgtctggcatgtatatgtcgtgtgggagcccaatattatgacactcaggaaacggcagaggtattgacaaattgatgtggcctttcgccgcagtggggccatagtgggaatttgcctgcgcccttgctatctatcggacactgcggccgcccccaaaatgcaatgcatgcgcctacaaaaagatggacgcgagaaaggagcaagttcggggtgtgaaggagactagattgagtgcagcgttggaatttagttcatagcctcctcgggtggtagtgtgggaggtcaagcagcagctgtcgcgcgccccgccgacaaggcaatgcaacataccaaacccgtggaatgcatgcaccaatccccgcacgtcacccactcgcatacaggagtgcgcctgaggtctccttggtgcatgtcaagccaacactgacccttatgtttgtcgtcggcttctttttgcggggaatgcctcgttaaggggggacatcatcacaatcgttgttcctcggacccgcagcatctcacgagccttttcccgaggaagtatcgtctatctggcaccatcgcttcccaaagtatcacgcagactccgattgaatg

SEQ ID NO: 7205 - DNA, 700 bp, Nannochloropsis_gaditana
aaacaccgacgactctacgacttccaccacgaccccgcccccgttgccgaggtacgccttctccttcccgtcctcagcccgctcctggagcgtatccggacacttctgcagcaatggccggggcacgcaggcctgatccaagcggcccgcgcggccgatagggtccgaaatctcggggtccggtcatccctttcccgccttctcttgggtctggaagctaccttaggagccgcgcaggaatgggaggcctacgcgagcaagtcagtgagtctgggcgcagagatggcagtcctggtgcccttggtcatgcgctggcggaaaatcgagctggaaagctggccagacctaatggagttgcaggcgcgaggggtggcggggaaggcgatgcggtactggttccatttgcaccgcttgactcgacaggccctggcaggggagggcgaggcggagggcgggggggaggacggggaaggaagctcctcgcacggtccggcgtcggcttggcttttgaccgagctgattccctcctccctccgggcgacccctccgtcctcgaccttccgttgtcccagcgttccccccgatttgcgggcgctattcgattcgttcgatttgatgatgcgaagcagccccttgggggaatacgaagcacgcttatctctgttgcgtgtatctgccttggacgtggtcggtgggagtg

SEQ ID NO: 7206 - DNA, 700 bp, Nannochloropsis_gaditana
cgtggacccgggagaagcacctttggcgaaacgagccctggtggacgaacgcctggcctggcttgacaccgaggcggcagcccggatctgggcccggagtttggaaaggggacttagaggggaagggaatgaggacggacgggggggggaaatgaacgaggaacgaaaagcactgcgaagggaaagcgcggcattggcccgtcgggcggttcaacggcccggggatgtagagggagaagagaagggaggtttcctgtccctgcgggcagaaattttggatgcggcgcggggactgctgtcttcgacgcgcttggaggccgtgcttcgaccctttggaccccccatgtcgggtcctcctgccgcccttgcgcacgcccatgctcaagtagaggcgtggcaagccgccgtgggatgcctggtggaccgtctacgcagagaatattcatatttcgctgatattatagatcccctcttgtccgcgataggggaagtacggtatgggctttcgggggtcgtggcggcggcgaaagcgggagcagatggcgggaatataggaaagggcagaaaggaggaggatcatccggttcgtgtcctggctcagttcccctttttgtgcccggagggttcggagggagggggagatgaaggtacagggaagcagttgggggatgaagaaaggtgggcggagcgtgtcgctggt

SEQ ID NO: 7207 - DNA, 700 bp, Nannochloropsis_gaditana
aattcacgcgcttcatgcgtaccatcacacccgacttgccactcacacgagaaatcaaaggggaatagcgagacgtccgcgtggtgcaccccttaacgtcccttctttctcggcagaagttgcctgccatccacgcttgctcgcgtgcatctctagccgcacagacctcctctatcgtcaacaacatacggcacgacagtggtaagagcgcagcccactcagtcagcctttggtagcctgcaacactcttcaaagaattgattctcgggcaaaaatatcagtgttgcgagtgatcgtactctctttcggtccatgagacaggcgtggcacattcctaccctcttctcttgccttctactctaccctagcacgagatactattcctgtccctgtcgcaaaccttgtgccccacaaaatctgatatggacgtcaaaactatcaacccacaaaatgacaggggtataaccatggtatcagcgcttctggcctctcgccgtttggtcgtaggctgcaatattagacaagctgccaatgctctgcttgtgaacgcgtatgctagcagcaacggtatgtttcattctgagaaggggaggggaggaaggaccacggtgcccattgtaagccaccacgcgaattaattcatgcatttccagcaattttaaaagggcggaggtatgtataaatgcgctcattcatgatg

SEQ ID NO: 7208 - DNA, 700 bp, Nannochloropsis_gaditana
tccacgggaaaagtgcaaaaatttcaccttcgaaatgtggccaaggaaagcgggccgcattaattcaaagaactaagacatggaaggaagggggaagatgaaggaaaaatgaaagggtcgagagcgagactgtgttgaaagaggaaaaatgcatggacactcgtttaaaacgaaattaataacaatttggcgtattttgtatttatccttgaatgatggtgtgttgcgtttcaattttctaaaagttcgataccggtctccccagggcaaggtaatccacttcaaaaaagtgaataagaaaattgactcgagaatcgccccccatctaaaccatccatgcacaaacatgtcccatcagggcccttgaaaagcaccatccgcgagtgtagggcgacgagcccgctttaaaaagatggcgatcttcgcctggagcctgcgtctttcccgatcttgggaaaggggatgacgccatcacttacatggatcgacaggagtgacatccatagtgcttagcccatgccacgatggcatttcctgtcaccgcacgaacgaccacgggggtgtccggcacgttttggggaccgtcagaggcaagcaaccacttattctgtgtccttctgacgtttttagggtgtcgtatctcacgcccgctctcacatctttgaccgtgcgcacagagatgaagacaatttcggccccg

SEQ ID NO: 7209 - DNA, 700 bp, Nannochloropsis_gaditana
  misc_feature (1)..(546): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacgaaggctcttcgcgtgctgtcctgaggcataatactggggtcttttttcttgcctctttgcgcgctgggggccgctctccgccttgtcctggtcgtcctcccttctcatcaccctgcgtgaccgcatcggccagggggagggcacgatg

SEQ ID NO: 7210 - DNA, 700 bp, Nannochloropsis_gaditana
gtgagtaagaaaaattgaaaaagtgggggcaaagctgtatatttcatctgtatatgacattttatcgtcactgtggagaatttggggtcgtgttgtccggagggacaactttgtggaagagtatttttgaaaaagtaaaaaaccagattcatcaaacagatgaactatgactatcatttcttcctgtcctcttaatatgattgtcatggagcagactttagtttgggggcaacattttttcgcctcacgtttatgtcgcatggcgcgacaaaagaagcatgtcattacaatcgtggggaaaaatgtttcgcgtccttccaacctttatttcttccactcatgtctcgcctttgcggcagagcgctgtagcttatccgacgtgatgaaagttgcgagttcctccttcgtgtcttttactgcggacaacgtgacaagagcatcaccttttcctgttgaccatttatctctttatttacaagcccgatgccatgattaaaaggaaaataatttgcggcccgatggggggcttgtccgtttgtcatggtaacggatactgggtcgcatgcaataggatggatgactcacagcttctcggtgcactgtaacataagggaaaattagcttcacattgtcagcggcttccatcacccattcatacaacaggagttgacgactgcctcgggtctaaattgcgaaaatg

SEQ ID NO: 7211 - DNA, 700 bp, Nannochloropsis_gaditana
  misc_feature (1)..(478): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaggaggaagaggtgctggaccttcgtcgcggggtccaagggctttggcaggagcatccccacccctcccctgacgcggcagccaacctgtgggctcgttaccgctccgcctccgcgcccctcgccctccgcctgtgcgagcagctccgcctggtcctagagcctcaggtggccagcaaactgggaggggattaccggtcagggaaacggatcaacatg

SEQ ID NO: 7212 - DNA, 700 bp, Nannochloropsis_gaditana
aataggagtaagaggacagcgcgtaatgggtgcgtcaatggtggccatctccatcccacgtgtcttctcatcgcacccatgtgcgcccaacgtttgcagcagggagagaagggccctgttgcattgtgtgtagggtatgcaattatcacttttttgactgcgctagcgactcatgtgaagccgacgtgggggttagggtacgacatgaagtcattgggacactacggctgaaaacgttcagcacgtcaaaggagcctatttcatatctgatacgaacttaagagggccttgtcctgtagttcatcccccgatagttgtcaccaggtaaagttgtcggggaaaagtactacgatccgatcaggagggcgggaggcgctgactagacgtgcaagactcaggcactaggacgacaatttactttacagccccgcgttttgtcccgtccaactggcgttacatgatacgcctgtaaaatccagtgcctcgttgaccacgtaatcacgaacgtggatgtagaccgcaaaggacaggatcttgacacaggatgggcgaagtactccgagaagcagcaaaacgctttttcgcgtgaacgaaaacgtccaatttgttccagttcgccccccgggcaggacatgcactcacctctgcttgtcccccaaaaataatcaacacaacatagctgccacaggttcgttccatg

SEQ ID NO: 7213 - DNA, 700 bp, Nannochloropsis_gaditana
  misc_feature (202)..(211): n is a, c, g, or t
  misc_feature (496)..(505): n is a, c, g, or t
atgttggtagattgcggccttccaggcggcggaagaggagatcttgggagccgagagcgaggacgagggcagcgacgaggacgaagagagaggagacaggaggaaggaggaaaaggaggaggaggagggggaggaaaagggcgggaaggaaggggagagggtagacgaggggaaagtagaggccgcggaggaggagaaagtnnnnnnnnnngcgggagacacaccaggtgaggtgaagagggcagggcaagaagggaagaagaggatgggcaacaaagacaatcgtgcaggtgaccaggtctattctctgctctcttaccctcagtcgccgcgcgtcgggccctccttcaggagtcctacggctttttctgtcaatgcgtggcttgccaaggccaagcgcccgaccggtcccgtgcttttcgctgccctgcctccctttctccatcccttcctccctccctcccccgcctgcagtcgcccgggtgcgacggcggcnnnnnnnnnngaaggaaggagggagggagggagggcacgatagggtttggaagcatgagacggggcaaggggtgtcctgcccgtgtccctcagcctttccttctccttctcgtatcagagcaccgcccaccgtctgatccgaggctttccgcccgtcccgtcttctcgaagcgtgcgatgttgggagcgcgtcctggctattgtc

SEQ ID NO: 7214 - DNA, 700 bp, Nannochloropsis_gaditana
ttatggcattaaaaggttttaaaaccgagagaaatgcacatgtcagcaattcgtgtaagaggacgtcgattggcccatggactgagccctccatgtttcatggccgcactccaagggaaaatgcgaccacgaaccaatgtcaagcttttatgataagccctcttttcttccttttagagctatcatgagggtacgttcagcagggatttactcgcaaagaaatatggtgtttttgttgcctagcccgtgggctattgaacctcctcactccctccctcccccaaaaagtaatatgtggctcttgaccgcttgtcatgtccgtacatttcccgatcctgtgtaaatgctgcaagtaaatgtacgcgcaggatccatacatctcctgtactctcacagcatttttttgtttcggcgtgaacatgtctcaaggttttcagctttgcttttcgagagaaagcacatagaagcgataaatgggacgagtgctttgtcatacgccagtgtgcgttatctcatccaataagatgagaatacccactcttgtgacctatgcacatcatttttcatacagtttcgaaaagtatggtatcaggagcgtcgaaaaagaaaaagaaaaaggcagcagcagccctttcccttgctggcccgacctcctccctccttaaagccgtatacacacacctagccaacacactgcatg

SEQ ID NO: 7215 - DNA, 700 bp, Nannochloropsis_gaditana
cacgcccacccgaccattgatcacagaccatcaataccactctcacgtccatttcaaaaagcagcagaccccgccattttcgacgcgttacgcgttgcaggggcgcgcattcaggcctcgacctccctcccttctgccccccgtgctcccaagacttgaaaagaaccgtagactactttgggtccagtggaacatgaacatacctgtgaattctgggaacgattttgtgcgcagcccagcctgaatattgtcgccgggaatttgggctgtccctcctggtgtggatacgggaaggaggagggaaataataaagcggtcagggcagcaagtctaaatcccaaaacagagcagagcaggggagtgcagacttaaataagacacgtgaggtgggtgggcatggtgaaggacctctatcagtctggcatgtattcgcgtgggcccgtctctcccacctcctggaccgactcggatctcgcctctcctgctgctcgtacgctccctgtagccgagcttttgtggcgtgtgttggctgacatgcccgccagcatgtccttcacaatgttgccacttttccacacataaatcttttccgtttgtcattttcgggagagtcgcacgttcgtcgttcaagcttgaggctttctttaccctccccatgcaggcccatccccctccttcaccacctcccccgctagcaatg

SEQ ID NO: 7216 - DNA, 700 bp, Nannochloropsis_gaditana
ttgcttaccttactggcaatgtggtcggcgacgcggagacaatctcggtacaactattttttgcgaattataatatactagctgtgagctttgtgctgggtcagcggggtggcatttgtgacggcgttacccttctttcctaacctcacctggacactgctttttccagcaacgttcttgagcgttgctgcgtgtgccgacggcaaagccatcctcgacgtactttgttctcagattcgcgcgtacccaaggcctgattgagcaggaatggcacacaaggaatgaaggattttgagcgggactgagagtctgccgtcgcaccaaggctttgacggtaaagactctccgagggcccttcgccgtgaggctgccatagcgagctcgcgtcgaagccgcgacttgcttgaaaccgcgtgaatgaaccggacggtcgcctatccaagcacttcgaagcttacttaccaaatttgttgcgcaggcttaatttctttatgcaaagcatttcttcgcccgtgtgtacaggacgtgcccaccagcaggaagacccgaatgagggttgaaggagcgctttttacttgtacactagctttttatttcgcttctacgggcgcggcagcaggcagttccaggtatgtatggcacagttaagtcagtttctgtggattgatggctctctgtctgacctgacccctccgacatg

SEQ ID NO: 7217 - DNA, 700 bp, Nannochloropsis_gaditana; identical to SEQ ID NO: 6479

SEQ ID NO: 7218 - DNA, 700 bp, Nannochloropsis_gaditana
tccttttcctaggcgacgaaaaggacgatcagggggtcgagcccccgcctttgtgcccatgcgcacgctacagcatggtggtgcaccggacctgggtatatgacgaaagcgcctggagcacgataaaggagggcgcaccgtgtagcgagaaggggggacaacccggcgggaaggcggcgccgaaccccccgtcggcctcgtcacgcctggcaccagggtcctcgtgcaggggcagacgtgcgactggctcgcacccgacagggaggtctgggagtcgtttctaggtcctggcgtgggactccttccctcggatccccctgtgctcacagaaatgtgcgcgcggattaagaggggtctgggtctcggtccgagggttgggggcggccgggccctggcgagggagcaagcgcccggcctggtcctgctcgacggccccagtggttcggggaagactgccctggttagagcggcagcgctagcactgggtctcgtcacggtgctcgtgcgtcctggcgggctcatggcccgtcacgacgtggaagcagaccaggcgctggagcgagccgccgccgcggccgccgtcatgggtcccgctctcctgttgctggacaacgtagacttgctggtgccgggcgtgggctcgcgggtcgtaggcgcgagcaggggggaggtggacgggtcgctggcgcgctgggtggcg

SEQ ID NO: 7219 - DNA, 700 bp, Nannochloropsis_gaditana
gcgcagacgagtgggtaaacacttcccgcccccggcctgccgaccgcaccgctgcagagttttctatattgcacactttcaaaattgaaagaagttcttgcgtcaggaacgggaggcatccatcgttggtagttttgcagggcaagcgggacgaatgcgtgcggcgacgggtatcttgccgtggcacccaaggcgagttcttcctggccccgacccgcaggaaaggtacgcgaggggagttcagcctggcattcggtcccagctgatatatcgaggttttcaaaactcacaatgctttcggcaacgacagcacatgatccttgtcgacacgcattgccacatccaccgatgggggaatggtgaggttgcagcatcgccagcgtatactaaaaggggaaataatgtccggaatcctactagaatggcctcaggcgggaacgatttcgacaattcaacggctgatcaatatattcatcctttgtattgcttgatggccgttgaggaagcggattggtcaggtctactggccatttcagggagagaccgaaaagagaagaagccgctcctgcaggacgtgtctcaagacaccaaagaggtagtagcagtgggtttgggaattcacccgtggaaaacacagagtgtgaaatcagggtgggaggggcgcttaaaagaagccttggagcgggatccaacccttatc

SEQ ID NO: 7220 - DNA, 700 bp, Nannochloropsis_gaditana
gtccatgtcttaaacggacagagacggacaacgggggataatattcgccaagcaccgacccaaaatataaagccatcctcgcgtcattcatgcatgtttactatgaggaacgtggttggcgtgctttcctttcctctgttgtattggagagagtagggttgatctttttttggtttcttgagacataattatcccctcccccatggtccgaggtccggaggaacgtttttattcgtgtcgaccgcgaaaagatccccctgaggaagatggcacaatatattctttcaccctatcacgagaaagctgagtgcgtcaatgaaaacagcacccctgatctaaggtgggattgcgaaaacgaagaaggtggccacagaatggtctcgcggggctcctggccgcttcggcgagatgcgccgatagcctcaccaacataacatatacacatatcccgcgatggtcccgtcgatgaagcgcttggcagatcgctatgagggcgcgtgtcacattttctgcttttcacaccgcggctgccctcttcctagcaatcaatttaatatgcccttataaacttaagaattgatgtgcgcgagacggataccatcatgatcgcgagtgtcaggccccggttctgtctcaccatgtatctttcttttctttttccgacttcaaagatccgccttgtcgcacatcaagtatcatg

SEQ ID NO: 7221 - DNA, 700 bp, Nannochloropsis_gaditana
gaaattttgcagatttgaccgtacccgctcatcgtcctcccctctacgtacctgagcctttacgaaggggtcgacgctccgaagctccaccttaatctcctggatagactgggagatgaagaccgtggggtccctcttgtggctgcgaatacccttcactaggtcttggagcgatttttcaaacattgcgattggaggatgaagacgggacagcggcagcaccgccaacactcacaggcacacgtgcttccaggcgcaagatagggcgctgtgttgagaaaggtaataaactactcagccgtgatgctgaacaaatgcgactgaactaacctccgaaccccatcgaacgagggaacgcaagctgcagcagtccgcacaccaagaaactgaacccttccttcatttacctgaccagtcgatatccacacgcacctgtgcgtgccccctttctgtgcgtgcgaggcgtgatgggagggtgagggaggggtccaagttccggccttcagtcatatcagcgatcatgagcatccagccgggaagtgtctcgccttcttattcggagactcaccagctcgatcgacacctgaacatgttaggatggacacatacaggagctcactgcgcgtgcaccgaggattgcgggaattgacgggcgcatgagtccgacaagaacctaagcagcacgcggtcgacagggatg

SEQ ID NO: 7222 - DNA, 700 bp, Nannochloropsis_gaditana
gagcttcgagttgctgcgaccagatttcacagtttcaggtgtctacagcccgttgtcatagccagacccagcttacacgtaaatatgtagaagataaagggtacgttgggatgaagcgctcttcccaaccgttcacaaattccaccaacaggccgcttagcgggtccacgcatccatggctgtggattagctagctgcttcttcttactcgatcctaccaatttgtcaaggccgtatgaatcctgcccgattttaaatcgaagccaaaatcaacagcaatcgcggaagtgccacgggcacatggatgcatgcgacgttccctcggatcctgtggtggaatatgaaatcagagacggtctccggcatgtaaagccgtacatttattcgttttacgcgcgagccaaaggccggtggtggggacgcacgatcttggatgtgtttcagaaggtattcaagttgtaggtcaatccggtcacgcctcccttcttgttgtctgggatcctaatgtccgttccaacgccgggcccaactgaagctctcctctccttgcatcctcccattctttcctctccaaggaatttcgcacctacaatccccaatactatgcggacagcatcaaatcggggaccatcaccgtgaacggacgccgggtctcccctgcccacgtccttcggaacaacgacctcatcctccacaaatg

SEQ ID NO: 7223 - DNA, 700 bp, Nannochloropsis_gaditana
cgtgaaggacagggtgatgatatgggcaaggattgaaaggctggaggagcccgagcatccatcgaagacgcaaacgaggtcaatctgcacgttgtaaggcctgcatttacgacatgggatgcgtgcaaaaggagctgcaacaagaaaaaagttgtggtagctgctaaggacaaaccgtcaggtacaggaggtcgtagctgcgggggcgtttgacagcgacccctgcctatgaacccaggcctccgtcttcgtagcaaaggcatacctgtcggtgaaatgcgttgagacgtgttttgattgcctgtgcacggacgtgatccatccccatctccctgagacagagggtaagcttgtccgtgggcggtggagctcgcctctcgccccgagcgtgacgaccggctcgctacgacacagaggccttacaccatttttacaggcatcggccgcgtgcaccaccgactcgacgcactggtgaagtctgagtgtgggcctacacctgctgctggcaccatttcccgtcagtgcgccgaccatatcatcgcagtcgaggctcggttatgctggtgactgggaccggagtcgacgaggtattgaccagactcttatttccccaccctcctaggctgcttctttgtgcactcattggagctacctgggcgcctggagtccctgacattcaccttgggtgggcgcgctcatg

SEQ ID NO: 7224 - DNA, 5 bp, Nannochloropsis_gaditana
tcatg

SEQ ID NO: 7225 - DNA, 700 bp, Nannochloropsis_gaditana
  misc_feature (350)..(431): n is a, c, g, or t
tagcatctgtcgaagcaagcgccagcactggggcagggaggcccacagcttcccttcgtcgatcaagtctcggagggtctgggcacagtactccatttggatgtacaaatacttgggtggggagggggggggaaagcgcatccctccccgaaaagaacccccgggtgacgagggagctacagccaggccaacgccggaggacgaaggtcccaccccctctctcccgggcgtggcaggagcagggggatgcccgtcacgtggcgtgggcgtgcctgtgcgataaatggatgtgaaggaccaggacaggtccccgggctccggcatgcgggccaacgggttcaggagccccnnnnnnnnnnnnnnnnnnnnnnnnnnnnnnnnnnnnnnnnnnnnnnnnnnnnnnnnnnnnnnnnnnnnnnnnnnnnnnnnnncctcctcctcctcctcctcctcctcctcctcttgtcgttgttcttcttcttcctgttcttcttcttcatttccccattcctgcttcccttcctctttttcttcctcttcttcctcctccacttcctctatttctcttctcgcctccccaccctcatcctcctcctcctccccctccccctccggccgcacctccacccatgcttggtagtacctgacgatgttcttgtggtacatccgactgatcgtcgtcacctcccgcctcaacctc

SEQ ID NO: 7226 - DNA, 700 bp, Nannochloropsis_gaditana
cttctgtgccgccatccattccaaatcccaggtcgcgtccacctcaggggggtttccatgcgcaaaaagcgcgcgaaccaagcgtctgtaggacagggactgagggttcgtcaaagtggccaaggcttctttcagatagacttcttccacctccatcttccccggcagatctcccgaggcgagaaaggccgcggcggagggccggagggaaggggagggatcaacaagctgctggatcaccttggcgaccaaggggggtacgcgcgccaggtactcggagggaagctcctgcgtggtacggagtgcggtcaaggttttggcgcgttccatcatggtggcgaagggagggtgcgtcatctcgaaaaaaatgatccccaaagagtacaaatcggctttggtgtcgtagcggccactcctcgggcccgacgtcagcaattgctgctcaggcgcgatgtaaaagtaagtgcccacgcctcctgtgatactcccgctcccttcctcccaccctccctcctccctcgacctctctggcaccccagcacccgcgcccctgtcctccactccaaccgcatctcctcggccgtcccttccttcacctctccctccagtaccaccgtcagtgctgttccctcgaccctggctgtcgtcctcgcccgaccccaccacccacccccttccaccgacgtgcctgccctctctc

SEQ ID NO: 7227 - DNA, 700 bp, Nannochloropsis_gaditana
cgccttcactcgcattgcttcctgtggcactctttcctcccctggctcctccctctcccccttccgctgtaaaacccactaccccctccagcgccgccgccaccgccttggggtgtgcgagcgcccccatgcacacggcctcgagcaggttcaggacgggcttgcgcgcctcgagggggacgtccaaaagctccaatgtcccctgcaataaaggcgcgctgttcaaacgcagcacgtacggtcggcctacgataccttccaccacctgccctgctgtccacaccacctctgcctccaagatctccccctgtcctggcgtgtgtcggccgtcgcagacgacgtccaattgcgcggcccattcttcctgcgggtgccccgccccctggtcggggccatggaagattctggaaacttcgtaccgcttcaaatgggagacctccgtgcgggccacgtaccgggcgaaaggaacgagtaggtccgaagggagacgaagcaccgccccctctgcgtccagcacgtccacgccctgaccctcccctccaccggtcccgcctccttcccgtcctccctcctgatggtgccggcggtgggcaggcacgagctccccttctcttcccgcccgcgccccaggggtcccagccctcccgcccaaggcggccggcgtcggtcgcaagagaggaacggacacgggcaaggcccc

SEQ ID NO: 7228 - DNA, 700 bp, Nannochloropsis_gaditana
caaaatttggcctcgacaaatcagcgacgtgctgcgcctgcctttctcgtgggagagtaaccactcatttcaagcacgagaagcggtttagcggccaaggaaaaactcatctttggtcaggcacaggtgttaaaattggccaagagaatgaatcgctccatgtagttgggagctacgcgagggctgctggaaaagaaatgacttcgaaatattcgtggtgaagtaagcgacaaaaatcaggataagaaggaaaattttacgcaaaattacaaaaacactctacatttcgggcgtcaagtacattcattttttatgtttgaagtctttgttttacccctgtattgactaaaaagcagccatttttctcgtgggcttcacagtccaagtaggaggcatgttttttccgaatcccgtttcgacatgtcatcggggaacatattacaaccttattaaaaaaaaattgagcgagatcctagcactcctggcgatacgtctcatgtcgagtgcttcctctgccgccttccccttttctcaatcaatgacgcccaccaatgctcatcaatctggcacatatatgcagagacttcaattgtctttcatgtcgtacaagtgtggtccgggtgggggaggaggaagctacagagggacagatccgggtggaggaggtggaaggggaggaggaggaggacaagcatgggcg

SEQ ID NO: 7229 - DNA, 700 bp, Nannochloropsis_gaditana
aaaacaagagagcaagagcatacggcctggagctccaccacaatgcgatgccgcgtcgggcgtaattcgccttttttcttcatatggactgcttctcatcctcgaaacgctagatcgggggcttctcgacttcgtaattaccatagtgactaatatagtgaacctaccgcccatagtctttacgctggagtcattatacaagactcattattttgaggtcaatccgttagcctacccggaggaagcggcactatcagaccccgatcactaccggagcgattgaagcgcccgaaaacgtcctgtgcatttcatcaagagagatttgtgcggagcaacccttaaatcaagagtggagcctttacaagatcgtgcaagtggggccccaaaaaacagccatgtgagcagcgaaaagatcggtctctcccatcggtaggaggcgatttgttctggttccgtgtctttgggctgcaggcttatttttcactttgcctccaactcctgtgccggcattatttcgtccacatgacccaatcctttggagcatgcatgagttcaatttgttgcgggcatcttcatttcgcgaacccgcctgtccatatggactgtgtcgatcagacggcgatcctatctagaatgtaacaactttcgctttccctgtccccttcatttatcagacaccctgaaaggtgcggctacaatg

SEQ ID NO: 7230 - DNA, 700 bp, Nannochloropsis_gaditana
ccgtcaaaggctgtcggaaaaattcaccaacgttggtatcccggtattaaagagcctctcaacgcgcctgtgagaattgtggggcataagacgtgaacgtgggcgggtaaatgctcttcgaccctaagccatcgtcctcctcaggaggtttctgcttgcgtcgctaaattctttcttttctcgttcgctatcacccccgagacacaacaacactcgattcccgcctgtaccctgacgccggcggggcgcactgtttgcgtcgagtgtcgcgagcctggcacgcctggtgtgtgcgtcttggggttgtcgttttcatggttttgggacttcctttgtcggcttgtgaaagagtcaaaagacaacatcactatgcttttgcttttcctcctttccaagcataccgcaaacatgcggtagtcgcgtctttgatggcttctttagggtactctgcacattttttggcactacctaaggtagatctccacacccactgccattcagtcgaaatttgtttttcatgggggaacaggaggggagatgcgaggtataccctgcgtctgtcataaaggaggcatagaaatgaatgatggatgaggttgtgcccactagcaaacaactttcttcaactcctggggcttcatttaattcctgacctcccgttcccgtccatttcacacgtgtgaatcggtacagaggcatg

SEQ ID NO: 7231 - DNA, 700 bp, Nannochloropsis_gaditana
ttcgcttactatatctctgcttggagagctacatttctagggtgtggtggtcatcggggcgattgtggcaacgttagctgagttggagggacatagacatagcgatgggatatgcgtatgaatggcaccacttataaattttccagtattatcctgtgcgagacctgcctgtcgttcagtcttgaagggcaaagaaagaagcagactttgaactcccatcggggtggtcttctcgcccggacagcggctaatcactttgactcgtgctcacgactagcaatttttgacatgaacagaatatatatgctcgctattatgcctcaaaggtcgttaaatgaaaaaatatccttaaccaaatgccccgggaggttgaaccgtttgtcgccggccgttgagatccgttgagaggcgatgatctttctgtttcgtcttgaaatccgcctctgaattactgaccatgacgccgtcgctggccatcatcaaggatgaaatggagggaaacattttgataataagatttacacaccagctcagggattgtgtttgttttcatctgtcaattttttccttgccaggtacctcgcggattgcctcgaggacttacgaacaaacagccctcttcaagcaagcaagtcaaagttttccgcacggactctttcgacgcaaaaactgaaaggttttcatctcaagtggtgacatg

SEQ ID NO: 7232 - DNA, 700 bp, Nannochloropsis_gaditana
ctatttcgcactttttggtcgcttaataaaacgcgtcaacccatagtcgaacgcaattaaaagagttcaacgatctgcaaaagagaggttctcacatcacccacgcgaggttggataacatgcactggaggtgattgtgatgagttcgtgagcggaaaagggagaagtgtgatgctgagacatattggtggactgtacgtattgcctacttttttggtaaataagtcttttcaaggcttgcaaatgccatggtccggaattttcccctccctttcactgggtcatatttccatggacgcttcatatgacgcggtcactgctccagatatatcggaatgtacggcatacgagtcgaacaactgctctagagacaacattggttgccaatggtgggcattatatgtgtcttatctctcgctgcttatccaccccccatgtcttgcatcccatgacagctcgctgataaatattctccgcagcggtaaaagcgcgggatttgcaaggctgtcctagcatagctgtagcgtgtgtctagacagacgcggcggacaggagggggaaaggagagcggagagtgcgtcgggaagggactgttccggtggaagctgctttcattcctccttggagaatttgaacaaaaagtcagaaatttgttggcgcgtgacaaagtgggagtaaaaaggacacgctcctagtcatg

SEQ ID NO: 7233 - DNA, 700 bp, Nannochloropsis_gaditana
gagaggccatggcaccctcaggactcctgcgcccgagcagtagctagcagcacttctcctcacaaatgactgccccgtggggggctttaggcagcaaaacccgcacgtctgtccatggaaagcggttcgagggtgtaaaaagcgtgagaaaacagttaagacaacgccctttctagttttaggtgcgggcagattgtacaaaagagcctggaaatggtttatgacggagacgcctcggagaggtgacgaaagcgttcttggaagggatcgtcacaagataaataaaaccacacaaagctccgaaatgctgatttccgtggagagtgaaatgacgcacgattaacaatttcactgaagcacatggcatcacggttggaaggttgttttggtggccctggcgcggggatcccctgcctcctgatagcccgtgtcacgtcacggggagggtggatgagaggcggtgcctgatatacctctacagtcacgaccacgcagcttggatctcgatattttacgcgctggaacgatgccaagctttgaatcgtacattcagcgtaaaagctttcatgaatctttcctcgttttggtgaccggcggccatccccctccggaaaccggtgacccctcgcccttcgcctcccggcaacagcaacaacaactcaccctctcctgtcttcggtcacctttcaccacaggcatg

SEQ ID NO: 7234 - DNA, 700 bp, Nannochloropsis_gaditana
tcctgaaggaggaggacaagtaaaccgcgccattcatgcgcttttccaccgtccacgacacctgcttgcatgaaacgaggttggtttccaaaattcggctaccgcaagcgagtcttgtttggggcacatattattttgtctcgtggttggtatgttccctccttgcctgaaaccatgcacattgttcctctcttggacaatatgaatccgtgagacatggattaaagatgcctcaagccttcgaggatcgataaattgcgcggtatacgctgaacaacggctggatttgtttttaaggctcggcgcatacattattccgtggtgccctatagttccttcttacccttagtgcgcagacataccgttgccctccacgctttatctccacactctttcccatgcgttgaggaaacattagttgaaacaccgtggcatccttcaaaatgtactgcttgacattgtcagtctggcccgtggtcatgaggcgaaaaccatcgtgcgaacgagctcagcaacacatgaacaggtatgaaggctttgtaccctccgaaaggattctcacatcgaaccagacctcaccgcattccccaaccacaacctgttattcttcacgccatcaaacgtatgattgcgatgcgacttgttaaacgaagtcactgatccatcctcgtgcatatcctggtgcgcgctttactcgatg

SEQ ID NO: 7235 - DNA, 700 bp, Nannochloropsis_gaditana
tcaagcagtcatagccccccacaaaactgcaatgcatgaagagacctccaaaggcaagaccaacgggcgggagagcaggctgcccctcccaaaagcaacccggatgtgacgatcagggcctgcgtgcgctctgattggtcgatggaaatttaacggctgacggttacttgagagcctccccatcccccccccccccgccgcttatgtcgtggcgtaccttttgagggtgaaatgtgttgaggatggtcggggccttgctacgtgtatgacgtctacctagttgtgactgtttgcatcgatatgtgcgagtatgttacccacggctggcttgtttttcacccgtcgtttcctcctttcctttggaaagctccgtcgacccactatttctagctacggcctacgatataacgcaaaaccactggatgcgtgctccagagttttagaagcgatgttttaattatataacattttgtttttagtaagtctttcacaaatgcatcgcggagcggaaaaaggacattgacgagaacacgttagcacgcacaccccgcctcgcctgtccgtcgtcatcactccccacacctaccgctttccctaagaatacatcacatcacaatgtcaggccttgactagagcaacatgcgacgggcaaaacacttccatttttgcatgctgtccgtatttgctgcacacgacaatg

SEQ ID NO: 7236 - DNA, 700 bp, Nannochloropsis_gaditana
tgcaatgtgcgcttggacagggtgggtgtgcgtcttcatcttttgctagctgagatatatggccaaggacacatgtggtattttgaatagaatttaagtaggaaaggataaaaacacttcctaaataagactgcaagcaatagggacaagtattaagtgcttgagcgtcaaagagggatagttcttttaaagacgacacaaaaaggggaaaaaaataacacggtaagtctcatgaagggcccactcgacacataattgaaaagtaatgacttgattattttttaaaaacaaaaaggagacttgaaaaatgatcggattagaataaaatgaggcatactatgattttcaaggttctgttcacgttgcattcgttatgccttccttgaaaatgggtacttgtggaccctaaaatttcatttttaggacgagcaggcacgtcagctgacgcctaaacttcaaggtcgtattgttcgtgatccgagtcgtgatcccagacagctaatttcgcacgatacgaaggcattttcctcgatatgggaaatgacaatgtgtgcaaggtattacgtagcagtattaaatcgatggccatacctgggcttagcctgccgtggaacgtcacgccattatatttgcgtctcataaagttaagttattttcgtattcatcacattgtctacatctctttgttttgccttgtgga

SEQ ID NO: 7237 - DNA, 700 bp, Nannochloropsis_gaditana
  misc_feature (1)..(420): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagcttgctgaacgacggctttgccatcgtcctgtacacgatattcagccgactggtggtacacgaagagaccctgtccgtcttggagacggtggagtccgccgtcatcctctgtctgggcgggccggccatagggctagtggtaggggcgttgaccagctacatcttaggcgtgcttttgaacgacccagcgtcggaaatcacgagtgagtgcgtggaggttacgtttgggacggtattacccggtgaatgtggactgtgtggccccatcgggcatg

SEQ ID NO: 7238 - DNA, 700 bp, Nannochloropsis_gaditana
  misc_feature (1)..(661): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagcttgctgaacgacggctttgccatcgtcctgtac

SEQ ID NO: 7239 - DNA, 700 bp, Nannochloropsis_gaditana
taatgctcgtaatcagtcagacgaacaatatattctgccgctagtatccatggcaagacgcgaccccgattgatgtcccatggccctttttcctgttgccttcaacatttccccccttcaatgcccgctcgtgcaaacgagtctgtcatgtgcctatggacatgtcctgtaaacacagaaatgagtgacgcacgttcatagtacttccctcgtaggaggttgcgagagaacaacacttcagcacctgtgtattcaccgactcccgcaagatgggaggccttccgctgctgggacctatccaaccataacaccttttcctgaacttatttattcttagatcattgatcgtgcactaaggctggtagcagcaaaacaggccactcttggagtggtaaaggaaagcgccagctcaagtggcacggatccacagcaagcggaacactccctgcaagacagttgaaatagccgcctcgttttgtaagagggtgctcaagctcctctttttcacattttctacgcgacctcggaggtttaaaacgagagaatatttatttcaccgtaaaagggtacaaaggggctcttgcgccctgtctcgggcacccttctttgtgctgagacggtacaaatggcagattttgcagagcactcggatccacatccatcctcctctgcggatgtgggtatggggactttcgtcatg

SEQ ID NO: 7240 - DNA, 700 bp, Nannochloropsis_gaditana
cgaaatccgaagcagggaagtgatggggatggggaggcgagaggaggaggcggctagcaggaccattgcaaaaaccaccttccccaaaaccaacctaccgacacaaagacgtcaccaacgcgtaatcccatcgcacagacttttcctctcttctcctgtgcgtgtgtttgtgtagcgggcgtggctgtgagccagaaattgcggcaccgggtggtcaacttctcggacgtgtgtcactccctcgattaatggatcgaagcttcctcccgcttattccttttaattccctgtggtcgtgaacaaacaagcaaggagaccgtcgagtatcactcgggcagtcggcaacaatcggctctgtgagatcgttggcaccatttagcgtctttggcctagtttctgggttttctgcctctcgcattctcactcccaaccctgcgtcgtgcttctcgaagagagggcgggcgttgagttgcatgtccgtcacagagaacgaccaaacctgcgaaacgacgaccgatttctcacctgaaatcccataaatgtatttaacattccattttttggcattccagggcgcgcgggagaagaaaaagacgatccagacgcgccgaccacagagagtgcgaccgtacacctcttccggcgccatcacgcaggcagctttcaggagtaccctgctgaagggattaaaatacccatg

SEQ ID NO: 7241 - DNA, 569 bp, Nannochloropsis_gaditana
ggagggagggaggaagggagggagggagggagggaggaaggggccataagagttgagtgcaccccgcatgctacctcttccttcccttgtcccacgtccgtccctctcacttgcctcccttgtccccttttaccccctccccgaacacttcccttcagatggtacctggatttcgagcgcgcggccaaggacctcgcccaaatcgagctccgaaagtccggcaaggtgagtactgtctcttgctctctccggagctcctggcggccagttctcccgcgtgctccggaaggcgggggggaatgcggcgccacgggctcaggccaggacgcgacaaagacattggcgcacgccccacccctccttttccctttccctttggcatggcatgcgccgatcggattgtttttgccaagtctctcttgttttactgcgtcacctcacgacgacatcgagtcctggtcccttcctggtattcaagtcttccgtttccctccctcctttcctccctccctcccctcctccttccctctttcattcccgcctaggacaatgatatcgacgcctgcatg

SEQ ID NO: 7242 - DNA, 700 bp, Nannochloropsis_gaditana
cgtgctctcgacaggcgtgctgtcgatttaaggaggtgcatcatggcattagggagcgggtggagccacgttggagacaggaagctgagagacaaaatggaaaaaggtgagacgacgtgcaagccgcttggacatacctcgagcgcagtctgcatggtgctgttgggcgagcattttatttgctttttgcggccattgaaaagcacgttcagggccatgccgctgctctccgttgaacgggatgctctcttcacaggcgggccgggcaactcaccctgtgacaccttttaggcgccaacgatagtggagcagtgtgcatacatgtgagtcattgaaaggcttaccaagatcaccacaagtcgtgccagagccgtggcgggattcatatcagggaaaagagagggaggggaaaggaggcggtcagcccaatctcccccctgaagtccctccctactaacggcaatggacgaatcaattcagccttatcgaatgcacaccaagactccagcgacggcatccgtgctaaacccaagacaccagcatggcatttttccaaggcccccaaggtcctgtggtattcccctacgttttctcgccaagaccgtccagcgacgagcgcacgttgctctcctggcctccctctcgcctccgctaacacccgtcatattgcccatttacacaggggaagggtaaaaacatg

SEQ ID NO: 7243 - DNA, 700 bp, Nannochloropsis_gaditana
ctaatatagtaattgccatcaagcaatcaagcctcatgtccaatccaattgtcatacatgattgtctacctagagaagaacttactcgaggcagaaagaaacatacgttagttgccatcaagcactcaagcctcatgtccaatccaattcacatacatgattgtgtacctagaaaagaactgggtgctacagacattcttgacatgttttggtcatccataagacctctaatgtcctaagaagacattgcagataggcctgtaccatttgatttgtgtatattgaactgatgatcgagcattttcttacagttcgacctgtctcaagcgtccataacagtccaaacgcgcccatattcaaatccacgaatccagaaatgaaagatttcttttgcgttctcttcgccgctgttctgggctttggaagcattttcacttccgtcttcagccaggtccggccctgtgtccacacagaccgcccgaaaagagagcaagaccccttgatacacgtcacggcttgcggccaagagtgtccacggcttgatctaacggctaaagttaggccaaatcctaggcgtgggatcatcgccgggaggggaaaagctaaaatcacaatcatacttaagagtcaagatcccgtggacaacgtggagtttcagttaaacctgccggacgggctgtcggttgatcgaacagcaatg

SEQ ID NO: 7244 - DNA, 700 bp, Nannochloropsis_gaditana
tcagctcgttgagtaaaagatactttctgagagctttcgatgaccttgaatacgaaggatcagggttgaaaagcattttcgtgtgcaacgctctcgctcgagggccttacacggttcggtcactattggctgggccatatgaggaagattaatatcaagttattgtttaaaagaaaagctttacccgttttatgtgctgaaaactttttaagcactccggaggcactggacccaccagatcattttcacttcaattctactacttcagtgagagccgaagttggcctcggatgcttagttatgcgggcgctttgtgaaattttaaagacgtatcgaacaaaaggcacgtctttcttaatggagagaggacaactacagcctttctttgtcatccgttgttacatgaacggcagttgcagttgcctatacagggtacccttccatgaggtttccttctttattcttctcggtgtaatcgtcccgtgtgagatgtatcttgtggtaagctgcatgaaaggatcaaatgtgcaacgtgaagcactgccactcggtcaaagtcgaggactggtgcgattatggtgccacccaaggtctcctggcctctccctcgctatctttctggagcgtttatccgaactttctccttgcgttgtcctcgaccccatcaaactaggtgtgaaagcaaagacttcagagaatg

SEQ ID NO: 7245 - DNA, 700 bp, Nannochloropsis_gaditana
attattaagtttcgtgttctcatgccaggagggagcatatgtatccaagacgcgtgggatgttttgcccggccattgaacctcctgtactcatgtggtcccaatttcatcgaaagcactgcgttcgtctcgcgcaaacatggtagggactaaaaaatatctagtctcacggcttttattcttccaaaacattagagctgtcaaaatcgctacattacccgtgcttagtcttgtcgcatctgcagctacccgcgcagccgccgcctttggcaccccttctcttgcgtcgaacaacaataacgttgcgcatcttgctggcttaaatcatcgtctatcccctttgaaaaccgttgtatctatttctgaacaagtctcagatacacagaataccatggaatatgccaaagcaatgaccgagacattggagcagcacaagcttccgcttcgcaacgatcgggacctggatcctttgttggagtccatcggggacaagcgatttgtcttcctgggagaatcttcgcacggaacacatgagttttatacatggcgggcacatatcacgaagcggcttattgaagaaaaaggttttaactttgtcggcgtcgagggggactggcctgattgctacgtaggtttctggcaaagtcgatcatcaaattcttccggaacttttcatttttttgacacatctgaaatgaatg

SEQ ID NO: 7246 - DNA, 700 bp, Nannochloropsis_gaditana
tagctctcgggttttaaaattcgaaaatttaaaaactggacaagctccgccccagcatcatcgctcgtacaaggcgattagaaggagcggagaactgatcttcgacgggagaagtcgtaacaattctcatgcgatgaaagtgaaaagctgcactttaacccattcgtctgttgactggtgttcaatgcggtcaagatgataggcaaaagcccttcacgcatatcttccgccgtgtcaatcccttctcctttcgagctctcctccctgggcttctgttccaggaaggtgaatttccttgatcttggtagcaaagattgattgcaaccgatgcgttatgaatctctgtcccggcatttaactctctgcaacgcgtagtcatgactgcctgatcttttctatccatcacgccccctgccggagatgctctgtattcctcgcgatcgctcacataactttaacctccagtgagcgccatgatttggatcgtaatgagccccatactttagcccagtaaattgcatcgctggacggatcgcacacagtgcactttctacacaatgtagtcgcccgtcctggcatctcctccctcgtggccgcctcatctttacttcatctgttgccgacccttctcctctcccgtccctttcatcactcaggggtttcccttcacagctgcaaaattaagcctaaatctaccatg

SEQ ID NO: 7247 - DNA, 700 bp, Nannochloropsis_gaditana
attgtatccattgataagatatgccctagcagtggggcaaagcatcgaattcttgcttgtcgaatcatgaccgaccattttgcttgtatttctttcttgctacctttttaatgcttttaccgcccactgttcttcaagcttccgccgcttctccttgtcgctcgaatatgagcgagtcagaaatggctttcttaacccaagcaaccaagagcgcgatacctgtatagaggtcaaagaaagctaccgaatccctgtgagtgagttattgaaaggtaatgatgcctcataagatggaatgttagaaaaacatcatcaccggagagcggctggtggaattctcaccccgaagagcccgtgggacagtagttccagccttacccaaatagagagatgttaatcccctgaatgtgatcattcaggagcgtgcatcatcgaatcctctgggtaaatctgtgttaggctgtgctccagggtgcccaatgtatggcagtctaatcaggatattacccaaatgaggtggactctccctccggtgccacgacggcttcccatcgcaagtgcggtcaatacaagttgttgcgtgcctttgaaaggaaaaattcgtcgtgacttaagagtccctgggccattctcccttcctattcatttctccagtctcgaatccttcaaagtagagaaaggcatcgggaacgaggtcatg

SEQ ID NO: 7248 - DNA, 700 bp, Nannochloropsis_gaditana
  misc_feature (1)..(552): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggggcacgtggaacgagggagcggcggctgtgtgagctcctttgaaagttcgtacgtgcagtgtctgccgcatgccttataccgacggaacacattgccaaccctccctcgcttctctccccccttcgcccagagagtgtgca

SEQ ID NO: 7249 - DNA, 700 bp, Nannochloropsis_gaditana
  misc_feature (329)..(329): n is a, c, g, or t
tgactgccgagtcgacggtcccgtctccacgcccatgctccaaacgaacgacaagatgaatgcggcgactctgtgcgtcgaaaaggctggaaataatgtgcccgacataagcgtgaattgccaagagtgacgtgttgtttcgtttgggtggggtttttcccgcccgggtaagcgacctcgtcatcccctatcagcgaagcctaggtgtccaaacccgataggccgtaaattgctgcgaagtcacgcctacagggaagggaaaactgaagcattggccttacaatacatattctgaggttttgactcagaagtggatagatgggggtaanctggatggcttggtggtgttttttggcgtgagcgggcagagcggactttgttcttgctgttccttagtaccttttcctgtctgatcctgtccctcctcatccgagatttcgcctcattcaaaaccattttcttcgcattcctgtgcttatatcatatcccctgactgatgaggatgtggtcactgttgtgaggttgcgtgcatccgcatgctttgagaaatgttctcgattggcttgtgcgccttgaagtctcaaactcatacctggcacttagctgtcttccacgcacagagcattgattcattctgtcccatttcttccatgaatctagtgtctcttaaagcgtcaagcagtctttgctttaaaccatg

SEQ ID NO: 7250 - DNA, 700 bp, Nannochloropsis_gaditana
attcttcacaaaagactactgtgcgactgggggagtcgtcaacgtttctgagatgcgatcctggcaagggtccgttgtggcgccgtttcgtggacgtagtggaaaatatgcaagggccgacaccactcaaatcgcctgcactatggagatggattggtcagcttagtctattttttgttggaaagttgaagtcagtttattctatctcgactaggactgctttctcaagatccttgccttgagcacaacagggggggaaattacagagccatgcacgacatcgcctgcccgctacaggtctttctttatcctccaagaccggaagtataataggttatgtttggcgttgatacagagcctaccccgtacacttgaaccctccgctgggctctcccaacctcccccctcgccttcctgctaacacttcctctccctccttacggatttccaacagagactgttgcacatgcccccttttgcacggaaaggtccgcgttaaagtctttaaggcctcctgtgtctcttcgacaaattataaagaatatcattcacatgaaagcacccagatgtaggcgttttcttggcacggcacgacaaagtctccttccaaccctcgtagacagtcttccgggctcactcatgcacactcaactcacagacctgcccctcgaaacactgaaagagcgtttagtagcgaatg

SEQ ID NO: 7251 - DNA, 700 bp, Nannochloropsis_gaditana
tttgattgcgatatttttctctaaaaactttgcctactagcccctaaattgtatgctcgcccgcgttgctgggtatgattgagcgcagtgagtgtatggactcctccggtgagtgtatggactcctccaacgagaagccctaggttcaatctgagcgaagtagacacctttcgatggtgcctctctctgttaagcaatatttagtgttatggcttcaaggggcttcaggaacttggtcactcgacagtcgggaaggactcttctcagcttttctcagcaaaaaatgcctggctattccgatgcttggcgagttgagaaatcagacagcggggaacacataataacacacaagtgcggccctgccgcgcaaaatggttgtacggcccgcgcgccctgcagcccaacgtgagggagctttagcgagctcacggcgagactcgcgacctgtatcatgacccaggcacgaggagacgcacgtatgtatgtattggaaggttgatgaggccatttcaagcccactttcgacctggatggctgtcacttgcctctacgtctggaaagagctattaggagcatcaataatataatacaccgggacaacaggatacgggaaaggggctgactcgacctcccttctgacttacaacacattccctgacgccttgtaccactctttgtccacacaataatccagagcatg

SEQ ID NO: 7252 - DNA, 452 bp, Nannochloropsis_gaditana
catgcgatgctcgatctgacacatcctggccgactacccatcccatcatgcacagagccttgctgtcgtggttaatggaggctccatctggacatcgaccgacgcgggcgccacctggacggagcaaaccgccgctggttcccgtgattggcggtcgatcgcgtcttcgtcggatggcacggtacgtggttggatgcaggccatgacacaaggggcacgatatccctgtcctcgatggtggtcccatcgtgtgtgcatatctcgtcaagggtcgccatgcgatgcccgatttgacgcatcctggttgactacccatcccatcatgcacagagccttgccgccgtggtgtatggtgcctctatcgtatacgtcgaccgacgcgggcgtgtcctggacggagcaaaccgccgctggtttcagtaactggaaattgattgcgtcctcgtcggatg

SEQ ID NO: 7253 - DNA, 700 bp, Nannochloropsis_gaditana
gtcctagccgtacccggatcgtttggccgatggcacacatggtggcgatattattatctgtgtctggtgatgccatgtcttttttgctggaatgtttgtgttgttgctgaatgaaaaaaagtatgagcaggaggcaggaaggtgtaactccgtggcgactgtaattcgcccactctgcctgctaccaaccatcaatacaaagttttttcagaaaaaaatcaacccgcatcgtttcgcacaacgcaggtgcacagagatgtacaagcctcgaaactattatgtccacagcattgtcccctggaacgggggaggtcgaagatgttttcgcgcagtttttgcatatgctgttttcgcgcaattttcgcagaatattttcgcgccataatgacggagaccagatgagaggtgtgacaggctttccctccttttccttgtgcggttcgagtgcgaaggcattgtcgggggggttgccacattgtccgcgtcactcacatgcatctatctctttggaatgcacagggagctgagacgtgcaaggcggacggacttgattgttggtgagagcctcgctggtttctctagcggcgacggaggagggctggaagctacaagctgcagccgcttgtcaccactagactcgtcattcaaggcggccgtacagcaaagcttgtaatatatatatttatacatatcagccatg

SEQ ID NO: 7254 - DNA, 700 bp, Nannochloropsis_gaditana
tcctcaacccaacggctctcaacggctgtcgaacatcccgggccatggaaggctccgtttcccacattcatgagccgcggagtgcttctccccgctttttcatatcgttaacactaaatatcaatgtatgtatgagagaagtcgggaaagtttgtcgcatccttgccacaatctagcgtaaaattgttttgcggggagtaggaagaagtcgagagcctgaattggctcttgccttcgcattttacatgagggggtcgtttagaaacaagtttcggtccattgcactcttctttcatgaaagagtccaacaatgacgacacttgtcgatttgctcaatccgtgctaaaaaactgaagtctcttgatgccgtcggcgccagtgacgacataggaaggcatttggagaagatgcagatggttggcgacgcggcagaggctttctagtcttgacaccgatacatgtgtgatccgaatcgagaataaaataataaatcaaaacactctgggacccgtgagcgtcgtgtggagtggctgcacaagacctgtggtggacgcgtggagagacttgtccttttgattcgcatcggcctgcatttcttgaccaccattcccccaataattaataatactagcacaatccatcgttcgccttccttctttcgtaggggtacacgctttctacctgcgcttcacagagaatg

SEQ ID NO: 7255 - DNA, 700 bp, Nannochloropsis_gaditana
acccgcttgcattttcagtaacccttcccgatcagattccacaccggtgtctttacccttaaaatcctctcctgtcaccaacgagtcgagtgctttccccaaagtcggcaatgagccgcggccgtcttgcctttttcctttcagaaattgactttcagagagtagatcagtgggaaggctttggcctgcagcgtccacttctatcgccttctggaacgtcggtattgcccgttcccttactttcatgcctttttcttcagactcaaaaagtgagaaagtagatttccctgtccgcgtcgtctccgcccacgcacttccttccttcctactgacgcttggcatgactttagattccaatggatccggagcgcgtctggccaggtgctcgatggtttgctgaagacgccgaggggggataggcggggaaccgagggaggacgataaagtgggggaatttatgccggttgacgacatttccagatcttttgatgctagtggaaaggatcgtgataagggatttgtttgcttccctaacgctgctgccaagaaacgtggatttgaagagtgttgagagcgaagacgtgcctcatcttggacagtttgctctgttttaacaagcctcgtcccagcatgatcatccgcatcgattgaaattcgtgagattttctcttcgagacctatgtctaggtccgcgtcgatg

SEQ ID NO: 7256 - DNA, 700 bp, Nannochloropsis_gaditana
gtgcactcacagacatttcgatatattaattcttgtgtcacaggggcgttctcctataaccttacaaaccccaaaaaaacgaaaagaccaaacttaaccacccaaaaagacgaaccatggacgcagctactgccaacgcaaacactggaatgaacggcggcgctaacatgcctgcccaaggtgcagcgactggaactggggctggttctggtgctcctatgtacgggaatgtacgctctgcttctctctatgtgggtgacttggccccctccactacggaatcgcagcttttcgaggccttttcgcaggtacggcgacgcatcaacggaggaaaacgggcaaccatgcggcgcacttcgtggtgttggtcaccatgggatggcaacggaggggtggaggacgaagaaaatggaggaggggtggaaggagggaggaagggaaggtgttgcctcactccggtcgtccccgcctgccttttgtctcacgttctcctgacatttccccctgactgtgcacagattggaaagattcaatcgattcgtatccttcgtgacgccatcacgcgtcagtccctcgggtaagcagagactttctcctgcgtgttttccgccctcccttcacagcctcctcccttcctcatgacaccgtttttgtccctcctttttctaggtacgcctacgtgaactactacgataccatg

SEQ ID NO: 7257 - DNA, 700 bp, Nannochloropsis_gaditana
gagaaggctggccctggtcaaccgaaatttcatgcaattcataacttactagctttccaaccttacatcacctcagcacgcgcggccgtcataccgttgtaggataatgcgactctctggcctccacattggatatttctgtgcagtatcggccgtacaacttggctcgatagccctggcggagggtgctgggtcagatgaatggtttattaagcctattcgcggtcgggtaagtacggtttctcataaagaatgagtaattaaaaagatgtaagagaatgtacaaatgaaggaaaccagcaagtctcatctttcaaatatttattttcattcttcgatattttttttaattatccactcatgccctcagtcaacctactatggcaactacggaggggggggcgcatgcggtttagaccagcccgatggctcggcaattcccgccgaggtgcgcttttgcaatttactccttcacgtttgtgtttttggttgttttccggtgtaagtatttagtttcaacatacgtgtcctccatttcctctccaaccatctgcagattcagggcatcgactttacagttgccttggatcagcctcagtttgacgtgggaggatgcgggatgtgcattttgctgaacggcacaggtgttggtgcaggtgggaaccctgtcaatggtatttatacagcgtttgtgaacaat

SEQ ID NO: 7258 - DNA, 700 bp, Nannochloropsis_gaditana
  misc_feature (8)..(643): n is a, c, g, or t
caagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctactccacgcccgaagaagcctcggccgccatccagaagatgaacaacaagatg

SEQ ID NO: 7259 - DNA, 700 bp, Nannochloropsis_gaditana
tccccgactgcagcggccacttcgtcgaggacgggatttagccggacacaatgaccacacctaggatatccggagtgtgacaagacataagaaggagaaaccacacacgtagacaaaaatacgctttaagacaaggacaagagttgagtaccagggcgcgtaaaaatccacaagccaagtattcccatcttccacatgctcccgaaaattatcttgagtgagcgtgaccacattgccagcggtcaaatctgcatggtcaatcgcaacagataggggaaggggagcaccccaaaaaagaagagagctggagaagaagagaaagacgaagaagggtaacttggaggaggagggagaacgcatccttcttcgcggaggcgcaggaagggaatgcaagtcgacgcccgctcgtttgtgcgcgttttagttgttctcacggtgtcgtacagcaacagttgaatgccctatgcgcaggtggaaatatgcgaatgattctgtgaacatatttcgtttttagggcctgaagacggtgtggcaacctcccccctgagaaaccgttaccgcgagtctcggcgacggggaaaaaataaaaaaataaagaaaatttcgtctcgtttttggccataattcaaacgtaaaaataaacgaggaccctaaacagggctacaaggcatcaattgacgcacattagtctgaaaagatg

SEQ ID NO: 7260 - DNA, 700 bp, Nannochloropsis_gaditana
  misc_feature (1)..(102): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttttccgctgcccgcccttatgtgagactttactgtgccggtgttttatatcgtcagtaccttcccgagcattccaagctgccggaaattgtgcccactcagggctgaaattcgagggtggttgtgtttgaggacccaagcagttacgtccgccacccgtgtgagtgagagtgacgaggagggctgggcagggaagaagatgggagcgttcggctcccccgctttccctccctccaccttcgcaaggaagtagcctgcgcggctaagggtcggggcactgggcgtggagaggaggcaaagagggtcaagacagggatggaaagggagatttttcgtcctgtctttcgtcaatctgctggcttgctatttcccaaggccccatccatccacggctgccaggccgcactccccgtgcgcttcctctgtcaccccccccctcttgccccctggcttttctacggttctgcgtacctgaacaattcccgccccttccctttctcaagcgcctccttccccacgctcccgaacgaggcttttactttcaaggcccgtgccacctgctcgaacacctgctcctctccctccctcccttcctc

SEQ ID NO: 7261 - DNA, 700 bp, Nannochloropsis_gaditana
cacgagagatgtgcctgccgtcccacacgttctcaggtcctcccccttatgactacccgaggggataatcaggatcaaaacggagcagatgcattagaaaatgggcagcgtcatgcccaggatcgggagcagatcggcagtagttctcccttaacgtatctgtatagggacgaacccttagggattgcgtttcttgtcccgtatttattgcttttcatcctccttgccctcgccatcgtccttatcatagttttggcccacggatttgcctagacttaagtgggtcaaatctgcgacccgcagctttgctgacgtgctcactatctacattttcgccagtatcttcaatattcaacagatttttacgaagaagcacatgttttgcttaagcttattggaggaactacagcgaagaacaactgtgatttacgatgacattgtgtttttgagcaacacacccgcggtatattacttgcaatgcaaaatttcgttgagatgatgatctgaaaatgaatatgtagttatggtgccgggggactccactcgcgctccgatttgcgtcgaagggcatcctcttttccccatgtgagggtacaacaccgaacagccgttacccgtccaacggctaaccaaccgctacaacttaaagacttgataacgtcgacattccaatcaattccaaaacttaacagcagggatg

SEQ ID NO: 7262 - DNA, 700 bp, Nannochloropsis_gaditana
aggtaggatgcatgacggaggtggtcaacctcccatgcttccttcccttccctcgtcgtcgcccccggcaggcacggggcccgagactccgggtacccggcggagggaagaaaggatcgagactatcgccttgtctgcagcggacagcgaatttcggcccgacgactgcgtagcaggaaggaaggaggagaccgtggtggggccagactcccctgcaccgcgtcctgcgccgaaggacgatggccccgggcccgtggcagcgatggacgtggaggagaccacgccgggcacagacgcggcgacgccggcacccactacgggcgaggaagaccatggcctggcagtcaaaggcggcggccttgcggaggctgagcctagagacccagcctgtgcctgcccggagccgtcccaagggcccgtgcccgatacaagccccggcgggagcagtcctggggaggacgtggagggggtaggaaaaggccgtggggagaatgtggtgacatcgggacccttacgtccaaacaaccgtacccctgtggataagagtcttgctagcatccaagccaagtgggaagccgcccagacctggggcacgcagatgacagcccgctgccaccggctgggagaactcagcctccgccagttgggtcagttgcgggccttcgtcgtccaggacatgcggcgcgaggccctggacatg

SEQ ID NO: 7263 - DNA, 700 bp, Nannochloropsis_gaditana
ttcaaaaagcaggaggggccagagttgctggctcccgccacactgggacaccaagtgggccacggccatccggcgacgagcacgtccaaatcggtcccggccccggcgaccaagaacccccggccgttgatgatgcacagcaatgctagcttcggcagcaaccacaatgctcccaacggagtggccggtgggagtggctatgcgcccctcggcatgccggctcgggtcatgcatccctcagggcccacgtcgacttcttcaggaccgacgagcgcactctcctccgcgcctatgcggaaggcagcggcgcgagtcccctctgttccctcgtacaagaccctggggggtggaagcagtggcacggccgccgtgggatgcagtgtggagaggacgaaggagcgagtactctggagcagcggcaacggcgtcaatacagcgcctggcgctggctctacacgatttaacgagaacgcgggcaaggggcattcggacgacaaggggagtggtggagggcgatggcggtaggaaagaccctgatgtttccttattcacgcgaatttgtcgcgggcaaaagtaattgatgcacaactgaaagaaataaacgaatcaccgctttgcaggggaagtgagtactccttatgcctaggtgcgagctacatgcccaacactttttgtgttcgtgacgaggggtggaccccat

SEQ ID NO: 7264 - DNA, 700 bp, Nannochloropsis_gaditana
  misc_feature (1)..(643): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctctttccctttccccacccagacgggggctgagggggttgctttaaaagaggca

SEQ ID NO: 7265 - DNA, 700 bp, Nannochloropsis_gaditana
  misc_feature (665)..(695): n is a, c, g, or t
gtacgtggcaaccaccactgcgtgatctcgctcgtacggttcaagcgtcagctgttccaaaggtttgaacttctcttcttgaagcttcttcacctgagtgggagagataaggacgtgagcgaaggggggggacgtcagcagacgaaacgaagaaagcttggataaaaaggcaaggaagagatgacacattagaaaaagatctaccaagcaaaacatgaagcagttacataaaggcggaaactttcggcagagaaggaggggcacgagggatgggaaggaagaggaggagtctgaagaagaagggagagaagggccaacgagccaaggcaaggaggacaagaaaaaggaggcaaacagaggaggctggagtgggcaagccgcacctctttttgaaagacagcctccggggcggcggtggagtcgatgcaggaggctttgatggagatgacgacgtgcccgccgttcttgaggaagtaatgggagttcaacgagacaatacgggcttggtccggttgcgccacgtccgcaaaaatcgtatcgaccataccgactgcacagagagggaacagaaagaggaagacggtcagcatcaaggtggaaggcgcaagccaggtgcaaagtcgacagagaatgccccgcccttccccccaccctcccccccgccnnnnnnnnnnnnnnnnnnnnnnnnnnnnnnntgatg

SEQ ID NO: 7266 - DNA, 700 bp, Nannochloropsis_gaditana
tgtttgttctgtccccccatgctcgagtccctctccttcttcctgaccttttgctgacaaggtgtgctttaacccaccaacaatccttgcaaacactttcgacaaaatccatcctacaaacctttccgagcgtctttatctgcagatttcgtgcccctcaatgctttgtcgagctatggattgcgccaaagccgacggcgatgccccttttgctcgcgtccttccctctctcccctccacagtcgcgttccttcaacccaccgcccgcaacttgtcacgtccgtcttcacccattgaggcttttatccttcttgcactcatcccttttgcttggccttcttcggcatgcgccgtcgtgatgcccgacagctttttgtcgacgtcatggcgttccgggcttggacatgggccaacctggcagctttgggccttgcccccctccccccgtccctgcctttgcggcttgcgcgacttctttttttcatcattatcggatgtgagaggcgttttaagtctaattttgatagaagaataccgcgttaggccctggtacttttttgagatcctctattaacatgccatgtcctttccgtcccccattttctcctccttcgagcagggattgtttgcttcctccttcgtcgccctcttccgagccgtccaaatctgaggtcgcttggcacaagagttttgcgtcatg

SEQ ID NO: 7267 - DNA, 700 bp, Nannochloropsis_gaditana
ggcaccgcttctcgaagatatcttgcctgtgtatcgacccaggaaagtctaaatcaatttcgtcccctttgaagaagagactcgttaaacaaatcatggaacaaaagagggaatcttacctccgaacacaagcccaaaacgaacgcatctttatgtccagtgataccctagcagtgtcgcctgcacaatgtgcatgtgttttcgcgtgaaaaagagcttgcggcaagtttctggcttgtgagtgtcggcaagcgatacgtatgcgtccttcacctctcgctgtcgaatagcgagtatacgaccttggcatgcagcctctgagccgtagtcaggacgtctgccttaagacacaaagaccacgcgccccggccatgcacccacagcggccaaacctaccatggtgcatcttgcggcgcacccagcgagtcgctgacacggagcacgcgcgcctggccgtggctttttgcaccttgttggcgggatgatctcactcccttcaaggtggtcaaccggcacgtcgaaatggaagccgcctgcccgtcagtacgccgagctcaacactcactgccttcctccgattcaacctcccacctcagtagtgggcgtcgcgcctccacttgtgcagggcttatgccaatatcagcccccgcacccggtcgtgccatcaagtgcgtggaggagaccggtataagaccagatg

SEQ ID NO: 7268 - DNA, 700 bp, Nannochloropsis_gaditana
  misc_feature (666)..(675): n is a, c, g, or t
caggccataagtgcgctcctgctctttcgttcagcgtgacgaccgggaagcttccatagcccccactcggttgtgccttgccactcctcatttctcaccccgattcacgcaccgaacgactcgtatattccaccacaggtttctcaatgtcctcttcccctaccagcccgcaccatgtcacccgaaatgggggcatgtgcccctcaagtgatccttgtgatcacttttccgaagagattgccacccctgcatctccaatgcctgaagcatcccaatgcgccgtcctttcccccgacacaaacacattggctgacggatccgcccagcaaggcatcgcaatattgaatgaagatgccagcgtgtcgggtttcggggaagtgcaacaaatggatgtggacaagggaagggggaaggaggaagacgctgtgtgccgcgtttgtcatactgaagccgaaccgaccgagggccgcccactttatcacccctgcctgtgtcgcggctccatcaagcacgtgcaccaggactgtttgatgcgatggctgcaggcgtccagcaacacggccaagaaatgtgaattgtgtggggcttcctttgccttcacggccttgtacgcgccgggggctccggcccagttgacctcgtgggagatggtgcaaggactgatgnnnnnnnnnnagtgtttgggaggcacacagacatg

SEQ ID NO: 7269 - DNA, 700 bp, Nannochloropsis_gaditana
tcttccgcggcacgtgtctccggggtgtcctttgcctgaagctaccatgcatttctttttcatgcctgtgctgcaacattcatcttaaaatatactcgtatcatgctagtgaaaacgtctttagccctctcctgagagtattcaaagaagaagcagacttaaacaggcctatttgtgcgactcaaaaagaagttcatcaagagaagagaacttaatcgattccgttcctccgacccgagtaaatcgccccaaagatatggcctttcgaggttgaaaaatataatgcgcgttcacgtaatatgagaagtttaaaccaaagtacatcgcctgcatcctgaagttgccgtctgtgccagctcattatccgagtggtacggcagcagggccttctgtcacaatgacacgtctgcgaagacgcttttggagcactgtgctgcgcataccaattatctcacacattcacaatcgtgtcccacgccatgccattgactgagaaataacattgcttttggcctcctccattaaagtttataggttcgagaagcaaccgaagcttgctgttgaaccaggccataagtgcgctcctgctctttcgttcagcgtgacgaccgggaagcttccatagcccccactcggttgtgccttgccactcctcatttctcaccccgattcacgcaccgaacgactcgtatattccacc

SEQ ID NO: 7270 - DNA, 700 bp, Nannochloropsis_gaditana
gcacccgacgggactaatgtctgcgttctcacgtaccatgattctaccagtccaattcttgtgtgcgaggcaagcgtccacaatctcatccaggaccgggccattccgactgctgccgcctccattactggtaccattgctcgacaacgacatcaacagtgtgtgatcaacctgtccatgattcagagtaggagagcgggttgggcatcggaggaggaagaggtgaaaagaagcatgaccgactttggagcccagtcgccaggaagtgcccgcaacttcacgagggcaccggcttcacgtcatctgcacaactaagacaccgtgtggacacatatccgtacacatgtttcgattcacagtgccggggggcgtgatcatagagaaaggagcctccccgccaggtgaaggggccctccttctgcgtgaagccgccaaatttctgtccctcctgccaagttcgcgagtccaacaaggcgtgccgggacgaggatggcgagtgaattggtgtttgcacgcggggaggtgtgtcaacagcggtcagagtctccatgttacaatgccgtgggcgttcgtatcacacgtctggggagtcgagcggagcggatcggcaagtgggtttttcccctctcccgtgcgtgctcataaccttgtgaagtcttcggaaaggtccgggtcatagtaatcgaggccacttacaatg

SEQ ID NO: 7271 - DNA, 700 bp, Nannochloropsis_gaditana
  misc_feature (1)..(583): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctctcctccaggtcattcgccgcctctttcaccgactcaacgccctcgacctccggcaaattccgcgtcccaccctgctcgagcgccagctcatgcgtcggggggtctgcacacc

SEQ ID NO: 7272 - DNA, 84 bp, Nannochloropsis_gaditana
gtaccggccaccacgcccttccctccctccctccccgtccccccctcccctccccgcccctccttcccctccttccctcccctc

SEQ ID NO: 7273 - DNA, 700 bp, Nannochloropsis_gaditana
cccttccccccccctccgtgcacatctcctccgtgtccatgtagcatggacgatcctaccgctctttggatgtctccgctgtcgaaagctcctccgggggaacctcagcgggcagacgcgcttggacggcttgcaagatcttgctgtcaatatcttcatcgtccggcctgcgtatgagaggagaagcacatgcacagcattgagaaggaaaacggagcccgacgcaagcggtccgtggcagcctgtgcctggcgttagacagccgggaggcacgcctgttgtcaaatgacaacaaccagctcagtccacaaggggcagtgtaccgagggacagaaaccatcgcgatgcgggagaaagaagaccgtcgacatgtgcactctaccgtcgactcaaattcctccctccttacgtcatgataacatataccacggccgcaaacgtgaccagcagcacggctgggtacacacgattgcggtgtgagggtggtggaggcgggacaggcgtcgcatgtgtcgtctctgtagcaagctgacgtagttgatgctgccatagaggtcttatgcgccggtgctggcgctgaactagggagggggaggaggtctgaagcgtcggtttgatagcaatgactccgcgcttgccgttgacagcgacgcccttagccatgccggcaatggaggatgctactccgagcatggccgat

SEQ ID NO: 7274 - DNA, 700 bp, Nannochloropsis_gaditana
tctagaaacgacaagacactgcacaagccggtgtcatgaagtcgggtaatagaccgtcctttgagaaagtatgtgcctaaacttgtaagcggtgctgtctagttgcctcggcgagtcccgtgggtggggaggtaaaggcttgagctatgcgaggtaaccgagtgcaaaaaggcaaaaacgggtcaaatgggatgtgttcttgtgcttaatgagtgttccaagttaaaattctcaccagctgttcgtgggaagttttggtcctggtgggattgtgctgttattacgttttatatcgagcaggttgggtacaggtgtgtggccaggacagtagcccccagcaagtccgagccgatcgatggcatgcgtgcatccacgcttacacagacaataacaagggaataaatccatcatttttgaagcactgtgtggatgcgaccctttcaactccaacccctagtggcatggacggtcatttccctctgagctcaccctttccgcctccccctcctcctttcccttcaggtcgatgactaacgcggaagcccgtcgtccccttcactcctccctcctctccctcctccttttgctgccaagcagcttcctgactgcgcgtgctttcttgcacccgtcgtttccttccccctccacccgtatgcaaacgcccaccggccgtcgccaccggaccgagggggtgcgcatg

SEQ ID NO: 7275 - DNA, 700 bp, Nannochloropsis_gaditana
ccaatgaggttgtgcctcctcgttccgagcctgccaatgtgcagctcccctcttccccccttccctccattgcctcttcctcccttcccctttctacgtccccccatttgacagaggagcagaaagagcactggaagattttcaacgaactggacagccaagatgaggcggacgtcatggccctctcctctttctttcaaatcttgtgccgtacggcctctgccgccaattcacaagccttgtttccccccatggaagaaagtcgatcgcagcgactactgggcttggctcgcggccatggaacggggggaggaaaagggaggaaagaattcgggccaggaagggggtggggcggtttgtcggacttcaaggtccagcacgtgggccgcatcgacagcaatctgcatgatttgggtgattttcaaatacccgcaaaacaacgcctgaacatggacgtggccctggacgtgatagactgcttccgacgcgggggaaaactgcaccgggattcagtccacaagattttaaaaagcagttactggctgttgaagaaattcgaaaacgtccgagccgttaccctcccgacgttgacggagccccccgcccagtcaccgggccgggagcgtcgttgcagcggtacgggcatggaaagaacggaggaagctcaaggaggaggggcgcccgcgaacaggaagtcatg

SEQ ID NO: 7276 - DNA, 700 bp, Nannochloropsis_gaditana
cttttccttcctcccctctacccctccttccagcgagcacacatcttccatcatgacgtggcgacagacttcgaagaggaggacgaggaggaggacgaggaagacgaggggggacatcctcaagaaccaggcaaaggtgacgaggagcaaggaaggagcgagaaaggtgttaaggaggagcaaagccgcgcggaacggacgggctttcgcgatgtcccgcaccggacaccggacgattcctccagcagcatcccctcccttgcgccctccttctcgtccttcatccatccctcctcctggtgcatgggcgtgatggcggggggggcggcccatgtctcggcgtggtggtcgcgctggaggcagggagcgcggaggaaggggaggaagaagaggaaggggagggaggcgaaagagaggggaggggagaagagggaaggcttgacagcggaaaagttgggcgaagggagttgtggagagctcgtgcggttgatcatgagagccttgatacccgtggtaagggcgggagagagggagggaggaaaacaagaagcagctttgctcgtttttcccgtgagcttttcgacgcggtctagatattggggaatcacttctctcacctttttcgatattttcctctcgatgctgtctagatattggtgaacgccatcggtgcaggcaccttggggtacttggaaggatg

SEQ ID NO: 7277 - DNA, 700 bp, Nannochloropsis_gaditana
  misc_feature (1)..(669): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccgacgcccttctctgtatcggagggcgt

SEQ ID NO: 7278 - DNA, 700 bp, Nannochloropsis_gaditana
  misc_feature (160)..(415): n is a, c, g, or t
ctctctcgctcgctcgctctctttctttcctctccattttcttctaccgtttcttcctccctccttccctccattagcttcatccttatgatttttgccttctccctttctttcaacttttttcctttctgccttccccactcgcgttctgatttgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggagggagggaggtggaccgggagggaggaaaagtcttttgaaaagagagagggagaaaaggaaaaaggacgcgggagtagaatatctcagagaccaacttcgtcgagccggagggggagagaggggcaaagagcaggagtaggcatccagagcggtcctcgctcctctatatccagtctttctctgatctcgagtgcatagagggcgcagtggcaggaagggaggcagtatctcactacaataatcgttttcgatattttcctctcgatgctgcctagata

SEQ ID NO: 7279 - DNA, 700 bp, Nannochloropsis_gaditana
  misc_feature (431)..(441): n is a, c, g, or t
ttgtccgacacggctccctctctcccttcctctctccctccctccctctttctctccctccctttctccctccctccctccctcagctccatgctttgggccctctcccccgacgagcaaaagtgcgccggcctttgccagcaccttctggctcaacgctccagcccccattttactgccgtcatccttaccttacgaggcgaacatgcctgtaaattacgcgcggtaggtcctcagttcctccctctttttcttccatcctctcctgagatcctcagagagagagatcctctcctgagatcctttccattctaatcctgttgcctttcttccttttaatactgggtggtcagattgcagcatcgaaacgtttgtctacacgcacatatatatttatataacgtgcatatatatcactacatacatataannnnnnnnnnnccctctctcccttcccccctccctccgtccctctctccctccctccctccctccctccttccctcccctttacaaggcaaacgcgccggacgctcccaagcggtcactgccctcagccaagacaatcttcccccccatgggccgcagacccttcccccctcttcggtgagctctcggctcttttctcggtcttcatgaccttagggcggtggaggcaggtcgttttcggggaaagagagcctggtaccacgtatgtatg

SEQ ID NO: 7280 - DNA, 700 bp, Nannochloropsis_gaditana
tatcctctgtttcttcaccgttggtcatctcaatttttttcctgctttcgccctcctcctccttcttgcccgtgcatgacatgacacctccctccctccctccctccctccctccctccttcctccgtctttcggtgctctctcctcagccactatcctctacttccttggccctggaggagtgggcgagcgtttcgagggggatggagacatcgtctttcagaagtaaggaggagggaggaagaaagagggagggtgagaaagggggaggagggcaggaaccacaaaggggcgcagaaactgtttcattccctgctccttgtatcaatatctctccatttaccccccccctccccctatctatctctctttctctctctttctctccgtctccctctctttctcctttctctccctctctctgtctctctgtctctccctctctccctctccccctccctccctctcactgtctcttcttgtctccctctctctttcactctctttcctcctctctccctctctccctctctctctctctctcccccccctcctctccctctctctctctctctctctctccctccctctccctcattctcccatcaaggcaccctgagagcgtcttcgggaaagaagaacaggtcgagtcttgccgcaccctcttgtgcactcagagccgcgtcagcccggaggaatg

SEQ ID NO: 7281 - DNA, 149 bp, Nannochloropsis_gaditana
tgcgtgccttgctgcgtcgcatcgacggggcgccgtacccggcgtaccgagacatggagcatgctccctttgatttcggagggcgggtgccattccgcctgagcgtggaccgggcccagtcggaccccttcgccccccccaccaggatg

SEQ ID NO: 7282 - DNA, 700 bp, Nannochloropsis_gaditana; identical to SEQ ID NO: 5105

SEQ ID NO: 7283 - DNA, 700 bp, Nannochloropsis_gaditana
tgagtaccgcacgtcgtcttgcgatctttgaggcttggaccaacgcacgctgctgtgcattgaatatgtatagtctgctgcatacggcaatctcgggacaaaggcagatgatggcgcggaaattttgtcacgcagaagcggcgcggaaagcgagtgaaatggacaaggcagacgcggcaccaagaatgcttgtacaatggacccagcaaagacaaggtacactagtgccgagacgaagaggcgcgatacggcggtcccaaagaaaaatgtgtttaatcgtccaagttgaaggcacataaatgttttccgccctgcgtatcgtcgtctcctctgccccccacggctttccaaaattcgagcaggcacagtgaagcggccgaccatgtcgaaaactgtcgtcacttgaaggagggcagggcgtgcgaggggtgacagggggaaatttctggtccgcgactgtgatgcacgacaggttgcacaggggccatggtccatggactgggcgagcgggcgaggcatgacgtcgcagagagaggcggctcgcttcgaagggaggatacttgcgcacgggggattttcggacggaatatttttgtcttgtgagctcacaatactggcaatatccagacaggctcatcaacgtatagctgggagaagtaattgagtcggaggccggtgagagacattcattatcctcatg

SEQ ID NO: 7284 - DNA, 700 bp, Nannochloropsis_gaditana
ggtgacgttatttaaggcggacctgtatggttaaaaagaagtcacacaaaggaatataagacgcgaagacatgcttatttgccattggctccattgtgctgtgcatcacactgcgtgcctaagaagatggtcgtcgcggggcgaatgctgcgcatcaattggaagatcggtggggaatactccatgagaagagtacgacactaaacgggaagacagagacaacatgataggcagagaaagatctctgcctggggccgtggtgagaggcaacgtggcacaatttgtctcatgcatcatgagcggttcatagggcacgacgtgaaagaggcatgggtacatgaaacagtgctcggaagagaagccagcgagtccatccgcgccaatgccacaaaacgtgctctcaaacactgatggacgtcaaaagagcgcgtgtgatgcttttcaatgtgtcgcccgacatattgtgctgcacgcccgttgctcaataccctctacgagaaaggggccgacgcctgccttttccgtgcaggatgcgtcactctttttccagccacatgcctgggtggcgctagtgttcgctgtggccgggggcgaggatagaacaaagcctcccgttccgtcatcctcccgccctgccccctgctgcacttgcaagacttgcaccaaatcacgctcttatactcgctcccttgtgccaggt

SEQ ID NO: 7285 - DNA, 700 bp, Nannochloropsis_gaditana; identical to SEQ ID NO: 5110

SEQ ID NO: 7286 - DNA, 700 bp, Nannochloropsis_gaditana; identical to SEQ ID NO: 5111

SEQ ID NO: 7287 - DNA, 700 bp, Nannochloropsis_gaditana
caggctcaggctcaggctcaggctcaggctcaggctcaggctcaggctcaggctcaggctcaggctcaggctcaggctcaggctcaggcttcatgctgatacgtggctgaaccaggtctgtgccgtctccaggaatgccgtctcgcttccagccgccttaccactctcctgccctacccctacgttcctgggagtctcgagcccttgaacccgatacattcatcgtatgcctgtgttatttctgagttgcttgaggctcaggcttcatgctggtacgcagctgaagcatgtctgtgccgtctccaggaatgcaatcgacatgtcgagtgttaaccctggtctcgccatgttgccgtcgccggagaggcttggccgcgggctcgtcagcgagcaggcagcctccagacaggcatcctgtggcggcgaagatccctggcatggaaaggacaacaacacgctttgcgagttttctttccctatcttgtaaggtatgcatgccatggataggaggcagtcacagagttgcggcgcactgcgtgctgaagaactcattacggaactgaagaatgattatcactaactgaaatggattcacggtaattggcactgaatcaacggttgcactgatatcacctccaacgaactgaaagactgcagactttttggtgcatccaaattaggaaataaataaataagcatg

SEQ ID NO: 7288 - DNA, 700 bp, Nannochloropsis_gaditana; identical to SEQ ID NO: 5085

SEQ ID NO: 7289 - DNA, 700 bp, Nannochloropsis_gaditana; identical to SEQ ID NO: 5092

SEQ ID NO: 7290 - DNA, 700 bp, Nannochloropsis_gaditana; identical to SEQ ID NO: 5094

SEQ ID NO: 7291 - DNA, 700 bp, Nannochloropsis_gaditana; identical to SEQ ID NO: 5101

SEQ ID NO: 7292 - DNA, 700 bp, Nannochloropsis_gaditana
agttgtgcaacattatgaatttgctttctcgagcgaggacatactgtaacaacgaaagactgttatgcaatgctttaagagggtggcttcctccccttttgtgcggctagtgtctgaaaactagcgttctcgtttccaagctcaccacctttttatcccccctcgctcctgaagcagaccgagggccatggagggtcttcgcggcccggctctgtccacaggaaggaaaagcgtcgattgtcgccacacgccatccatattggaccttttttctgtactcgtccatcgcgggcaggggttgttacgatcggccctggcctgtccctccgtccgtcgcctccgcctctcccctttgccttccttcctctccatggcaatccttctccagctcgcacatgcatccaccacgtgtatcccagtgaatgcggcgagagcatcaagcccctgctgcttcattcttcctcgtcctttcctctcccgcatcgccctgcgccttccctccctctcccctcctgcctcatcgcatgcgcacatccggacaaatcgccgattttcaatggtcaatgaagagcgcttgggtctccggaatgtggacccagaatttgcgttttttgaccaagcacaaatgtatgtcagagccgggtctgggggggccggggcggccaccttcaagctgttgaacgggcggcagaaggggatg

SEQ ID NO: 7293 - DNA, 700 bp, Nannochloropsis_gaditana
gggggaaaggacgaggaggaggaggaggaagagcaggaagagaaggagaagggccatgccctgcatgttttgatttttcttgagcgggagaactccggagacggggatggtaggtgcttgtctatatgcgggccctgcggacccttgtgaaggtaggaggagaaaaagcatggtcgatcaagggtgtagcgggcggggaaagcgaggataagcgactgggaggttggcaaagggctgagggagagggaccgtggaagggcaagcacagtacgcgtggaggggttaggggcggcaatgagttgtcaaagcaaattagtatatactataatgcccgcctatattgcaatgccagcatgtattttacggccagccattcgggtccgagggaagagatatttggcagctttaatctctctccctccttccttcccttccgcgctcccaccctccctctctccctccctgcttccctccttcgggttctaccagaggccgtcgccgaggcttcctttgcctcccccccccactccccccgcggacacataacgctttgttcccttcgcctttctccctcgctcgctattctcccatctccttccttccctcccttccttcttccctcccttccttcctccctccctctctccttccctcccctccctctcactcctcctcctttcccccatgaccttcctcccct

SEQ ID NO: 7294 - DNA, 700 bp, Nannochloropsis_gaditana
  misc_feature (1)..(697): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaca

SEQ ID NO: 7295 - DNA, 700 bp, Nannochloropsis_gaditana
ggggaggagatggggaggtggatacgagatggcggagatctttgccatgaagcaggcatgacgcgggaaatgtgccgcaccacctgaccatcatctctttgaatcatctacaaagatcgtttgtcattgttttgtatgtcatgttcaaaccataccgatgtgtagccatcaacaggttgggggcatcgccgcaggtgatgtgaaagcgaacacaggaagcgagtctcgctcgtttttccccttttcttggtgaaggcattcgcttcagtaggtgacatgtatacactataaaatctcctggagtcatcttcacaactgttttgaaagcccatcttccactcgaggaccacatattaaagagtggagagaacctttaacctccccaccctgttgacctcaggacctctgtgggatttttcaggacaaactcattcagggcagtgacccgtcctggtttaggaggatgtgctcgtactgcctctatggcaacatttgaaactgtgtaacagcaggcgagatgggggatttttcatgatgtgacccctgtttttgtcagactgcgacataacccctcctagctcttttgttgtgccaagcccggtggggtgtttcccatcttttccgcttttcctccgatccattagccctcaaccagttcgaaagcttatattctacccactcaagacagagacacaccatg

SEQ ID NO: 7296 - DNA, 700 bp, Nannochloropsis_gaditana
ccttcgtgaagctcgtggatggcataggccaattcggtccgcagcttccgaatgagagggttcaacgcctgcaatttgatctcttgtccctccaacacctcccgcatgtccgcaaagtccgcggcgttgcccgtttgcatggactggacgagttcagacgtaaatggcatttcgcttttgttacagctggtgtcactgctgccgctgctactggcaaagaggcggcttgacaaggtatgtttggggttgagccctcctgaaatggacaggagaaggcgccaaggaccactgtaattagcaagagtgctgctaagactgctggacgtcccaagaaaccgttgggaacagaaaagttgaggatttgtgaaggggtgaagaggtttggcagtggggcggaaggcgagcgagtggaggagggagggaggatgagacgggcaggccaggaggaacaaagacgtggtgttaggacggaggaatgcgaagtggcgtaaatgtgctgcaaggaggggtcgttgaaatccaggcgccaggatggctgtactaagtttgtgtgttggggagatcgtgagttgcaagaaagggggagatctcagcagccggctctcacagtagcccagggttaggtcttttttgtttccctcctttctcaaaatctctttcccatagcacagctaggactgaccagagcgtggtattcatg

SEQ ID NO: 7297 - DNA, 700 bp, Nannochloropsis_gaditana
cagaaggaagagaaggaaggggccgtgacgagggcgcatgccgcgacgtatgagcagcgttgatcaaaaaccgatggattggtatgctttggactctatgtcggtgtagtgtatagtggagatgctcaatacatccaaaattcgcatcgagagtacacctcatgatatcagatattggccaagtccgtcgggctagacaggggaggttggtgcggccgctattgcaactttttatgcgcacgtgacaatgaccacacggaaggagggtgatgaaatcacacaattaacacgtacgacgacgaaagaggaagagtcatcgagggaaagtatacttgtttgcgtcacaggggtcggagtggcactaggacatgttgaaccgttactgggtcatagcttgttttgagtatattatcgtaaaccctcgctcggttccacatcttcggctgcgagccgcgttgctacaccttcaaataattgggcttgtcagtatttttgtaaatgggcgtttggtgctttataccggaaaacgatagattttgctcctcatcgtttattttggagccgagaaagcatatttttccttctcccaaagactgtggtattgtacttgaatcttacacgcactcacacaactctttggtcacgtgtctctccttcaaggatcagcttgatctcgataaataatccgctatcaaatatg

SEQ ID NO: 7298 - DNA, 700 bp, Nannochloropsis_gaditana
  misc_feature (473)..(482): n is a, c, g, or t
accaacagagggacttggcgagaaaaagggggcgtccgaggctgaagcctgggagggaggagtggaggagcaggagggagaggcggagggcgggggggagggggggagcccgagcgcgttgcctcctcgttgtgctttgatctctccccgtacataggcatcctggtactgagaatggaatggtcagaatggaatagtcagtaagagaggaagaaaaatggatagatcccagaatagaaggatcgaaaagctcggcaggcgcatcatcatcagaacgttggcgctccctatccctcccagctcctttccctccccctcgtccccccaccaaccaccaacgcccacaatcacctacacacgcacatgcccgcacaaagactctcccatcccccttcaattacatattccgttacgcaggcatgctcctcatcccacatcaatggacgcgcgccggtcccccccccccatccttnnnnnnnnnncacgttgtcatccttcattgcgtacatatttctccattgcatggcacaggagatcccacgctgacgcgtcggtggcggtacggatgcctcctctcctccgcctcctcctcttcacctccctcagtgcctcatgtcaacctttcctcctcccttcaagaacattccttacgtgctcgccaccgacccacgccttctcccgaggccaagttatcacgatg

SEQ ID NO: 7299 - DNA, 700 bp, Nannochloropsis_gaditana
  misc_feature (1)..(186): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgaggtattgggcctcaaaggacaagtacaggtaccaacgtactagtcttgctccctttggtcgtgctcccagtcgggttcaatgcatcactgctgcagcatacgcgcattcgcacaactactggccagttttatacatccatgtggtacgggggataggggtggtgctaaaggattagttatgtgaagttcatgggcaagatttgttgtccttgccgctttgcacgtcgagccgggcatggacacctcgtgctctcctgtcccgcattatcgaacctaacaaaaacgaggaaacatgttgactacatgagtagcacgccaaaattacattcagagtggcatagaatttaaaaagggggcataaacacgtattttcccgcttttaatgagccagatttgggacgggtacatcgacagagcgatggcaaggacatacgctaaaaaagcatgtggtacggccgtcaagcctgagtatctcacctgtttattctacaaactcaacaatccgtaaa

SEQ ID NO: 7300 - DNA, 700 bp, Nannochloropsis_gaditana
  misc_feature (1)..(563): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgtgcgatatgattgttggtcgacttttcctcctactccttcctcaagctcatccccctgccttacagcgcaggcgtctccttcatctcaagtccttctgtccttcctagaccccttcgcttctcccagatatg

SEQ ID NO: 7301 - DNA, 700 bp, Nannochloropsis_gaditana
agtcgcggcttgtgatcaggcagaggcaatgacgtgtgtgaggagacggccgccctggggggtctgtggcaatcagtcctaggccgattttacggacaccaaacctccaaggcaaatcaaaccacctgtgatccatcgtgtgcccagaatcagtgttcatataattatttagtgacaccgatgccctatttcgtggcccggtttgtcaacgaaatggatcagccacggcttaaagcaatcatcgctcctttctcagcgacgcactgctctcatcaacaccacaacctcggggcccgtgtgcccccatttgaaacccttccaccggcattaggcttcggaaggaccatgtgcggggaatgcgatgcgttttgtctttcttgtgatgtcattcttgtgaaggactcattacctgcgcgcgtcagttgtttttaacttgctcctttcggaagagagatgcaggtctccgcctcttatctctcctgaccgctctcctttcatgaggccgttcccttcccctgttcatcacgcgacgatactcttaccactcctgtcacgaccttacaggcaacggttttacggggatccaacttccagccctgggcttgagcattccaaaggcttttctcccttgtccttgactggactttcctaggcgtagcagaatcgaagcgttgctatcaatcgcacggagggaagcatg

SEQ ID NO: 7302 - DNA, 700 bp, Nannochloropsis_gaditana
ccacggcttgagcggtgaagcccgcgacaaatgtgatgtggaagggttcaagatggttggcccgttggtattgggcgcttgcccgcgtggggtgagtgtcgatacactgtcactccttgcagagggagggggctgtcgaaggctcgaaggaagcggcgccatcttcctgtcctctagcccctatactagcacacacacgtggtcaaataatccgtacgtgtgcaagtggtgggtacctgtgtcaacgaggcagagagccaccggggcgtgagttttggattggaaggatggaggtcatcgagacaagcgctttctcccttgctcggtccacaaggaggagaaggcgccttgctcctcgcccatgatgggacagaaggacagaggaacacaaaaagggaacaagacgacgcgggtagccaagccgtgtatcgaagtctgcgggatgatcggtgcgagtctttccgcagggtaccgtccatgtcacgtggaggtcataaaaggtgttttgtttgcttgggtggggtgtcgaaacccgatgctcacgatgcgactctctttcccaatggtattttgtactttaaattttagttttgcaagacattaagcttaatagcataataacgtggcttacctttttcatttttttctcggatttctggacaggttgtcacattgtggggttagttttcctccagacatg

SEQ ID NO: 7303 - DNA, 97 bp, Nannochloropsis_gaditana
ctatgtttcccttccctcctcctcctcctcctccttctcttcctcctcctcctcctcttcctccttctcctcctcctcttcctcctcctcctcctcc

SEQ ID NO: 7304 - DNA, 700 bp, Nannochloropsis_gaditana
ccagacgttggacatatgtttgggtatgagaccaccggctctaagcatagagcttccaaatccgcgaagggaggaaaaaccacagcaacgataaggacaacaacaacaccataactctgccaaaaagcgtcgttactgggtcggaccgcggcacaggctgtgttgcgtaggtgattcatgacgttgtgtggcgacgatgagtcgaacgtggtgtttttagacgcgcagagattttctcgcagcatggtgactccacaacaggcgctttctaaaggctcttcgcctccccacccctgccttcctctttttttctatcacagggggcactcatttggccggaagggcgtctgcttctttttgtgcagtcttgtcttcctaagtacgtgtgttgttccccgacaagtgggctacgacgctctcaagaggttagagtgggattcggtgggagccggcgcaaggttgtctcctgacgctctgaccgctgtcttcttccgctggccatcacgttcctggtgggccattcacagtattaggtggaccgtacgttccaacggctgaaagcgccggagcccaatttcttctggcgtgttcaccgaagacagagcggcaggcagtagcatcacaactctgcacctctccctcgtcgctgtaaaattgaagccgccagccccgcaggagcaaagagacggcgaccacgatg

SEQ ID NO: 7305 - DNA, 700 bp, Nannochloropsis_gaditana
ctaagccttatgtccaattcaatgtccatacatggttgtgtatctagataagaacttattcgagggagaaagaaacatattagccaaaacttgggacttgcatgtaaatttgatcgacgccatatctcaccgctctttcgtatcgtacagctaaggactttactcagccttctttgcatcatgcgcagtgcactttctttgcttgttcttggcgttaccttcggtagtaccctcgtcccgaccgctggtcaagacctcaatctcaagtcgattcgcactgtcgatagatccgtgacaaacaaggacacatggaaaatgaaaggtaacatcaatgatccttctctgaccattgttccggcgattggccagactggactgaccgtcgaattgcaagacgccgctactgatcccttgaacaccgtagcttttgcagcgagcgattgtcgtgtacccgcgcatggaaggagggcaacctgtaaaattagaggagctcgcgtgtcgattaagacatccagacgtccaaaggttaaaacgcccaaaactgtgcacgcgaaaagctacaactcaactggtggttactacagtgtgaccggaacttttcgaggattgacgttcctcgagaacccagtggtgtctcctcttacagctgcgctaagaattaacggaagtgtgctgtcagacactctcacctcatgctatg

SEQ ID NO: 7306 - DNA, 700 bp, Nannochloropsis_gaditana
ggcatcctcgacgccaaggacctgaagcctgttctgctccgtctgcttcctggagcccgcaagaagatggccacgctgcccgcagagcgcaccctacttcaacatgatctaagggcgtacattcatgaaattggccccgaactcggttctctttatacggacaagactgtaaaatgggaagaatacattcgcaagtcatcatccgccacggacctccaatcactgctcccgagcggcagtcccaacgggaaagacggccgtgctgagacggaagacacgcgaggggagaggaacggccacgctagcagcttgtctttcacgtcaccggcccttgcgcaagctgtgaatggacgaggcacaccttcaccgcttacttttaagccagatgagcagttcaataagaaagatgcgtgaagcagtgaaaggtgaagataaaattgaattgggggggggaggttagaaagtgtacatgtgtgttccgctatttgataggctccaaactctcgaataacacgcgtccagtgaagcttttttcactagaagaaagaaaaatgcgatatgctaagtacttggcttatacaaaaaaactgcgctgaaaaacataactttaaccagagtgttggcacacatgctcccctggacgtcacgcaaaaaaaaagaatttttgctcacgccgcacccccattcactcattcggaca

SEQ ID NO: 7307 - DNA, 700 bp, Nannochloropsis_gaditana
gggaaggaggttggagcgtcgtggtagcatgaacgacggccggcgtggttgaggtggagggagcggtcaagagccaggaggacgcaaacatgcccgttccagcagccaaaaccccccgtcgatcaatatctagattggttggccgtgctggtacagccctgctgtcttggtcattcgcaggatgcgtggacatggtggcaatgaagagggcggggggaggtcgacgagggcgggggaggtcgccatggcccgtcaaagtgaaggaaacagcgcttggacattgtgcccaaaaaagcaggagtacggacgcccaaagcgtaggccatgtgaaagacatccgtcctgtagtgaggtgggagatgtgtgcgttgcgaaatggtcacccatgatatcaacgcgtggtttttctggacagaatgagcactacgcagtagcgcatcttgtaacgcggttccgagtcggacccatgccccacctggctgctttcatcctcaccatgacatacaccattgcgaacaggcacggtcgcctggcgtgtctgtgggtggcctcatccgtggcacaccaggttgctgtctctcttagaattgtggtgagcacgcaaagtgacctcaacagcaacagcagaagggcgtgacccgttcacggggattccagagtcttattgttccgcccacctttacacgacctttgagccatg

SEQ ID NO: 7308 - DNA, 700 bp, Nannochloropsis_gaditana
tacttatttgaggtaaaattgaggacaaaactaatttcatgtgttgcctagaatagaaaatttcatacgagcaggtcgcaatcgtggttaacaagattcttggggggggaataaggagaaggggggatgcaaacaaggtgtcacatagttatggggtggggaggttttcctttgatcgatctttacatacacttctgcggtaaatctgcgacttcgatgaaaggttagcaatctccttacatttggtgactgaatgtctgcagtcggatggatctgcatgcaaatgctaactatacttctttcgcttcctaaaacaggatactctcgtaggctcctttccccccggtcactccaccatgtgggcacttaagctgtcccgtcctttcatggagtgtcacacgcgacatctaaagccaaatttgcttgcaaacggatacgggctctgggcgcgggagggaggttcgttcttggttataggttgaaagtcttgcctccgagaccctacatctctcttcaccgttgtacttaaatcctccttccttctgttcgtggctaccggttgaaagcgtacatcgtcttcacccttagttaggactcttttcgttcaagtcatgcgttggattgttcatgtgttgcgtatacctcctagctcctcacgactccattccaactcatttttgaatttacaaccgcgtccagg

SEQ ID NO: 7309 - DNA, 700 bp, Nannochloropsis_gaditana
accacacatagtacgctgcacacgagactagggcttcgtgcacggtacacgtgaagaaaggtacacccaaggctctcattaccgtggttgccagggccaatacggcgggaggcgggcagcctgaaattgttttctcgatcatgtactcttcgaacgccgagacgccaccaccttgccaccaccagtgaaaaccatgcacaccgacccccggcaccccccccaccacggacatcccaacaaagcaaaacgtgacgcccagctcatcgtatcccggggcgcctcggtgggaagtgacgtgcttgaagacattaattagtgtcccgggcaaggactcgcgttttcgcccctagcagccatcgtgacgcgatttcgttgaaatattcaggcggccgtccgcacttttgtcccatcaatccccggtccttattcgtcgatgactgaccaggacatacacgcacgataggggccccggtgcacggtcgtgacggaaagccgtgggtttgtgtttggttgacttcagacctatcgttgctgcatggcaaaggtaaggcatcgcctcctccattatactcaaccccgtagttatgttccgcaagcttggtcttcccgtccttgtctacgcacgtagtgccaaaaatatctaacttatccctttccctggccaacatactagccaaaaaatctgttcataaagctaatg

SEQ ID NO: 7310 - DNA, 259 bp, Nannochloropsis_gaditana
ccctccctccctccctccctccctgcctccctccctcgcgtcctccttcagccttgccacgcccatcgcccggctctcccatacggtctgcagtatcgccgacctgctcctagacatcctccatccctcccccctgccctcccttcctccttccctccctccctccgagcgttcctctttggaaagacgtcaccggcaccgacatcaacttcaagaacaagtttttgtctcccttcagcgccgcattcaaaaagccatg

SEQ ID NO: 7311 - DNA, 700 bp, Nannochloropsis_gaditana
  misc_feature (672)..(681): n is a, c, g, or t
tatagataaagcgccatgacattggcggaacgttcagggactgagggcgtacggctgtgtaggcgggacatgctggcagcagctagcgacccgcccccacgttcttatttatgcacgatcactgggactgacggggacactctttctaacacatatgatagcatgtggacgctgcatattcttgacggggttccgatgtttgaaaattttactctacctgcggacgcatagtctcctggcgcctcgtctttcccaacgtgatactatggacccccccagctcctccaccatcgatgccctgaaagccctgaattgtagcgcgcagcacttcgttgcggttgtggcttcatggctggttactgcctcgacgccatccacatcgcaaaacaccattgaattcccgacatatatgtcattcaactacaccatgcaccactctcctccctcactcggcgacaaggccgcagctgctgaggctttagccgaaagtcaaacacagtgtggcaacgtcccgcgtctggcgtgcggggccctggtggaggacgaggctacaattggagcgaagcgcctgggcgagtacttggttcgactgctgcggggggagtccctgtctgccccttcgaccttactgcaagagacgtccgcgttcgggtggctcccggcccacgcttnnnnnnnnnngaaggcgttcccgaggatg

SEQ ID NO: 7312 - DNA, 700 bp, Nannochloropsis_gaditana
agatgggaagtatatatatgtagaggtaaaaaatgttttttgttagacacaaggtgggaaaaattctacaatcaggccttaatttttccaggtatagattaacatctacgaactcaagaaaagaaatgtataattttaatttcaaaagattcgttttaacgttctgtttcctgtcgtgggagctgtacgaaagatgaagggctttattggagaactagccacggcattcggggtacaagcaaattacgtggcgatctgtgcatttatcttcaattttatgctttcatcaccacgatttaacgtttgcaactattactggtcgacgagaaatgccgtcacaccgtaaggttccgcttccagactacccggatgtggccctcggccgttagccggtctcgctgctcgagttccgctgcgtgcggaagcgcccatcaccgcgggcacccagccccgctatcgcatcttgtacagctaagttcatgttggctcttctacaaaggtcttagttatttatttttgatgtagtcggcgggctgtaagggagatatgcagagagagcctatcgcaaatctctcacggcccatgtcgttgacaaaagctcctcacacgttccggcctttcatacttttcccccttacgcttgtagacactcacacccagttagtgtaatatatactcacggagttttggaaaaaggatg

SEQ ID NO: 7313 - DNA, 700 bp, Nannochloropsis_gaditana
ttgttgacctgttgatccaatcaaccctctttgcggtctttcccctgacgtctatctccactatcacccccagcttccccacaacctctctctttggcttcctgcactccatggtctcctagcgctttcgattccgatccatccccgatttgacaatccaagcgcgtcatcaattgccgtaatctctcttccaatgggcccaccatcgtctctctttccttctctgtcttcatcagctcctcttgtgcctcccgcaaggaggctgctaccgattcttgatttgcctccagggacgcgttcacagcgctcaagaaacccacctcctccctcactttccgcaagcgttcccgagcccctgcgcaacgtttctccatttgccgtttttcttgccgcaaggctgccaccaccgtagcgcccgacgaggaagaacgatgagaaggcgaaaatgctgtccgtagcgcagccaagcgtgcctcaaagcgcgtttgttgctcttgtagccccgtcgagaggagcaccgtgtattgctcggcccagttttccagcttccggtgcaccatttcctcttccatcgcctccggcaagggcgcatgccgcggccgttgattggaattggtgttaggatcggggacctcgacgattttccctccctccccaccgccttctcctcctgcggagtacggatggtagagtaacctgt

SEQ ID NO: 7314 - DNA, 700 bp, Nannochloropsis_gaditana
gacgatcgatcgaacgtggagtagaagatgaacgcgcacttgcaccctcagactcgctctcacctcccggaggtactttcacactcatgtaattggacaaagtcgtaaaattttagttggagaaaggaaggtggcaacagctgctataggagtatgttgtttcttcgttcattagttgcagccgctttgatgccatgtcatgggcacaaagccgactgactcaggttccagcagcacgaaaaatgcacaagaaaaggattcaacgttgttttttcctcacttttgttgtgtaacgcttgaaagaaatcgtacgtcgtattttcttgccccgtatacgcttccattggcagctgagccttttgtaccaccacccggggcctaagcgctccgagggaatagcccgagttttgatttttggcgcgaaaggagaaaaaaggacggagaagaggggaagcgaaccctgcgacggcaggacacggcgttccagaagctacgccgttcccgcatagcttcccgggcatcttttgtgtttcatgtggccttgtgagtgcgatgcgtgtaggaacgtatgctactgcttattcaagcgctaggtacaacttttccgcatttcctgtccggcgtgttatcttcatgatatcctctgccttacacgtcacacacccgtggcacctccaaacccttttcacaaggtacaatg

SEQ ID NO: 7315 - DNA, 700 bp, Nannochloropsis_gaditana
ccattcgaagagcacgtcgtcagggggccgatacatttcccggtcccagccgggcggggaataaaccgtgtgcgcctgtcgccgcatgctcgaggagaaaggcgtggaagcggaggcacgcgtgacacgaacaggtgtgacttgcggaacgagtagtggcgggatagccggccttggaacgacaaagggggcggcctccggtatgcagaggaccacgacatacgcgatggcggcagaaaagaaggggactcgtggtatagatacgcttacacgagctggctgttttcttcttgatgatggtttcatggcactgagaggaggaattaattatgtgtgctgtaaagtagggtagcgcagtgagcaggaaaagcacaaaaatgggaaatgctaagtgagcatgactatgaattattcccagcaaatgctttctcgtaatatcttgccacctgagatttgcgctgcagtacgtttcctggattattaatggatgtatttcccttgcgaaatccccctgatcaatgacggcatcaccagggaggcagcgaggagccatctagtatcttcaacccgccccctttctctttatgggaaaaatgtcccacgcggggcttatgtggccgattaaacatcatctcaggcatcgtcttactgtaccaaggagcaatatgcttagttgctatatgacttggactcgcatatg

SEQ ID NO: 7316 - DNA, 700 bp, Nannochloropsis_gaditana
  misc_feature (47)..(56): n is a, c, g, or t
ggcaggccctgtatgcccgaacggaaggccgtcgtacccttctgctnnnnnnnnnncaatctccgcgcctattggagtccatctcctggtgtcaagtaaccattccacgtcgcccaccatttcctcgtcctcttcctccctttcgtttcccaccccctgcacttgacgccggcgtcctcgctgttccgccctcccaatgcctctgtcactgccgtaaagcatctcgccatccgacgccggtaggaaaggcgcttctcgcgcccttcgatacggtcgacgcgtgggtgtggtggggttaatcccaccatttgccatggacggattctcctccatcatgttctgttccggagatgagcccaaaaggcagtgcaaggagtcaatttcatccggcggtttcaatcaagacaaaacacgcctccaggctcacatatgcggcagcatccacacgcctatttcaaaacgatggctgcatgtgggtacacagctgggtcgagcgggccgcacaaagaacacaagtgtcggtgtggtggtctgctactagtgcctctctcgcaagcagagtcctctctcccggcgagaagagacagcgcttgatccccttcgaggggaagaaacaaaggattgcccgcatttcctcaggcgttcacccgcactgcgaccttttctctcctgcttgtcacctgatgacacgtacagcatg

SEQ ID NO: 7317 - DNA, 700 bp, Nannochloropsis_gaditana
tacttccgccacggaagcaccttcaacattgtagacggagacctggggtcgtgcggcagccataatgctgtacgtatgtgcacaaatctaattttaaaaacgaggtgtaaataaggtgtgtccgtcaaaagagaagcgagtaggaggcgatagaagcatcagtggctgccgtaagttcatcacggtcctcagctcggcacttcacactgtcactaaacgcgcattacccaattggatctcttgcaaacacaagaaactgcgaaaagcttatgttggttcattgcacacaccaagaggattgagggtcaagggcgcttgagagccattggggcgacgaacaaggatggcgtcatcgctgccacagacctgtgtaaatcttggacgcatagacctatcgaagcggagagcaggaacggggaggcaagcgcaacatagaaaggccttgctgctcttatggaggactgcgtcctaccccgtaacttgataggcaattgtggaacgctctacatatgctgctctgtgataccatagaaagcactcaaaagaagatttggctgcggagactttctcgtaatgaggacctgataattcttgtcttagctcttctccgacctcacttccccccattgattacattctaggtagattgttttctgtagcgttcagacgcttctcgaagcattaatcatcaagcgggatg

SEQ ID NO: 7318 - DNA, 700 bp, Nannochloropsis_gaditana
ctcggtcttacacgccctccccaattcccatggacgaggaagcggacaaagacgccaaagatctctatgctatcaaggtacgtgccagtacgcagcctgcactgcgacgcaaagcatcgccctcaccttcctatcgtgatctccgactcaggtcttttccaaatctctgcttctgcggagaaaaaattttgggcgaaatcgagaggggcgaatgagtttgactacggatctggacaaggtccagcgggagatcgccatcatgaagaaactgatccatccccacctcgtcagcctttatgaggtcatcgacgatgccagccaggacgccttgtacttggtgctcgaatacgtgcccggcggcccgatcatggactttgacgcggaggagcgtcggtacgtgtgtcctcggtcttctgacggaatgggcgttttgaatgaggtccacgcggcgagagtgctgagcgatatgttggcggggctcgtctacctacacgtgcatcatattgcccaccgagacctgaagcccgagaacgtgctggtgggccgcggaggccggtgcaaaatagctgattttggtgtcgcgcaccacttcgaagaggaagcagcgcgtatcttggctctggacgaccaggccggggctggcgcaagcagggaagggctggcgacagggacgacgtcccccagcgtctcctcgcacgag

SEQ ID NO: 7319 - DNA, 700 bp, Nannochloropsis_gaditana
cgcggcaaagtttcacatcaccaatcgctatcaaaactacctcattagcatctccaccgcacaacccttttttcccaagccatcatggtgatgaacgtagctcgcctacatccttacccctccacctcggatcggcctcctattccggggatgaattccgtcgtgaccggactcgagcctcacgacgtagtgctgacgtccttcgacaccttcaaacactcgacgacgagcgcaaagcccgtggacatgacgctttgatgccccgggatacgaaaacggcagccatcacaaaggatgaattggggggactaatgaatgtgaaccagtacgctataataaaggagctcgggaggggcgcattcgcagaagtcaagctttgcaagcgtcagtatccttccatcaccgacccaaccttccagtcaatggcaacgggttcaggcgagtaccacacgctcgtcagcggcacaggctcccccaaggcaagacgcgaagaggcgagtccctctccaccaaggggcgtctcgcccacaagcgaggagtctcggtcttacacgccctccccaattcccatggacgaggaagcggacaaagacgccaaagatctctatgctatcaaggtacgtgccagtacgcagcctgcactgcgacgcaaagcatcgccctcaccttcctatcgtgatctccgactcaggtcttttcc

SEQ ID NO: 7320 - DNA, 700 bp, Nannochloropsis_gaditana
cgcccctcaccattacatttgaatgcccgtccaccatcccgtcccgcctcttccgacgcaaaagcctgggcagacctgaacccgccacattccccccaagcgtcttcatcagtcacaccaaccgatatttctcgttttcaagccattctgacatcgacaaatcccagtcacgtctctgcaaggatgggcaatgaccaagccagcacaatgaagccctcgtgcgatgcctcctctgcaggcggtgctagcgctattcctcgctctccctcctccgctgccggcaaactcctcttggccccctcaggcccggacgacgaaaatttgctcgccccctacacacaagactggactcacaagtggaaagctccccagtgcccagcggtccttcaaccccgcacgaccgagcaggtggcggggctcctgcggcattgctatgagagagacctccacgtggtccctcagggcggaaacacgggtctggtcgggggcgggatccccctcgcaaacgaagtgatcctttcccttgcgaacatgaatcaaattatcagctttgacgccgccagcggcatcctggtctgcgaggcaggctgtgtcctcgaggagctcgacgcgtggttgcgcccccatggctacatcatgccgctcgatttaggcgccaaaggcagctgtcaaatcggcggcaacgtgtccaccaatgcgg

SEQ ID NO: 7321 - DNA, 700 bp, Nannochloropsis_gaditana
gaggcgtcaggaccggccccagcctcggcctggacagagtcgggaacgcccccgttggcacttccttgactctcgctgggaagaacagcttcgtctacctccattggagcggggaactctgcctccacggcggatgacatctcaggcgagggggcgctggccgtggaacccgtttcttctcccggcgcgtcaggagtccctctggcagcgtcaccgggcgacatagcgatattttccgctgttggttccacgtcgaggtcctttacatcgctatttccctcgttcttggcggcggcggctcgacctgcaccatcgggcatgctaatttgcctctggggtggggggggaaagggggcgtattgaccgcgaggaaagttactgtctgcacagcgtaaggcgcaacaacatgcaattcagacatcctcttaagaagggtgcaacgaaaaagtcaaatatcaccatttcaggtctacatctggagcattccttctacttcgtacatggcaaagtcggactcggatgttcaaagccattccagtaacctcctgtcctgctcctcccaccgccccgatgccatgtaatccaaccatgctctctaatgctgatgccgtaccaccacatccacgcagacaatgttggcgatgcttaaaaaaacacttccggtcgatcgcttgccggcgtgcacgctgcaaggtatcaa

SEQ ID NO: 7322 - DNA, 700 bp, Nannochloropsis_gaditana
cagtcttccgggtgacgggaggtttttcagcgacatccacacgcctagaatgacaccaataagaaaaaactgcgcgacactgcgtacctgcgcgcgttgatgaggcatgagaaaatggtcatgatatgtacaagatgaggtattgatgaactcatttcccccgaatttcagatttaagacatagaatatacctgctggtgggcaagaatagggtgtgtggtccgtgcggctttgggaggtgctgacctgcaaccgtcgaaaacctgcatctgagtcttaagagattcgactacacggcagcaatatttaagcatgaagtacacaaacaaattgttctttttgtctgcgcgcggggattggttcaagaggacttgcgggaccacacgactgccgagtcgtctcctaactgctccaagcaactgtaacaccaccaggaaaattgtcaaatctaccgaggccacttcatcaccattcctctcaccctgggctatctatagccgctggttgaaagaccatccagtgaaaacaaagctcctcacctcctctttcatcatgggcgcgggcgacgtggcgtgccagtttctcacccgatatgaaaagcagcaagaacgtgctacagacctcccgaatgtggcacgttcgtctcccactcccactcttccttacgactggtaccgcaccgctaaatttttcctgctgg

SEQ ID NO: 7323 - DNA, 700 bp, Nannochloropsis_gaditana
ggccccattggtagaaaaaggggctgcaaagcattccgtgtgagtttcacgtgtgtatttttaaacggtcgctttgcaacggacgctttaaagcatggcttctaatcgacaagtaaaaccgctgttaaggtgctccctgacacttgggcatgcttctcaatcacttccgtgtccctgtagagcatattgattcttgcttgaaatacatcataattgtgcattcctatgcgtgcagtcgagaaaggcgtgtcttcagattatttcctatttcccttgcacgcgcacagcctgcagagcctccctacgccctgtgtaaatgtcgtcaaacactcctggtgatcttttgctagcttgctagtttatgaattgccagtaagcagttaggcctcatgtcccattcaattcacatacatggttgtgtatctagataagaacttattcgagggaggaagaagcatgctagccaagacttgggacttgcatgtaaatttgatccacgccatatctcaccgctctttcgtatgtactacagtgtaggatcttactcgatcttctttgcatcatgcgcagcacactttctttgcttgcccttggcattaccctcggtagtaccctcgttacgaccgctggtcaagacctcaatctcaagtcgattcgcgctgtcgatagatccgtcacaaacaaggacacatggaaaatg

SEQ ID NO: 7324 - DNA, 700 bp, Nannochloropsis_gaditana
  misc_feature (1)..(420): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgctttattggggggggggggggaaggtcaagcgtgttgccgtatccgcgtagccgtagcattctgagccattcctgtgtaccccccatcttgcagccgccggcttgagcaagattcacttggcacctaagtctagcactgctgtgtgtgcgacagacacaaggtgagtacatctgttagggtgtctttatttcctcgcatggcgccacatcccgttttcgaacgtgcccctcgagcacagctctctccccatctcttcccgactcctcgacatcagc

SEQ ID NO: 7325 - DNA, 700 bp, Nannochloropsis_gaditana
atgcggcatggcccaggaggagagttgtcgcccgctcgccggatgcttgagggctcccgcgccccatggaaacaggcagagaaatgccaccccacgaggtcatggccatcatgcggcagcagagagcagacactgtgctaggttgtgggccatgtgtcccgcctggatcatttgtgtccaaccttctgcttcggggaaaaacaagaaggacttgcttgtcgtccgaggcaagatatcttcgtagacaacgtatgcccatcttgaacccgccctcctcaacacacacatagcccggcgcaggttcttaccagtcatggtcacgacgcggagtaaggcctcgtcgccaggcggtgttcccacgaccccggtgcgaagcagacgtcgaagcagcgctaatggagatctcagcggtccggcctcttctcccagtccaaggggggcgggcaaaggaggaaggaaacctaaagcagtgatgaacaagagtaccgcagcacttccgaaggcatggagatttctaaattatatttatttgctgatggggctactggcattggcaggaggcatatgggtggcttttgaagtccaactgaagatgacgggaggggagggctcgagcgagagggaggcaagggcacctctcggatcaggcctcatgttcgacgctgttgccaaacactacgatagaatgaataaattaatg

SEQ ID NO: 7326 - DNA, 700 bp, Nannochloropsis_gaditana
ataagctttcggtcacgtcggccttgccacaattattgtagtacaatcagtgctagaggctttcgtgagtgaggaggcgagtatgcgagaagtggagagtaaatgaagccggaaatgccctttctgcaaccaaattcacaaaatccatgaaccggaatgcgtatgtcaaagctcagcacactttatgtgttttccgccatgattgcttgtgtatcgggagcgcgggtatgggttccaaacgctgatctaagaaagcgagtgggcgagtcgttggagagacgcgataccgtgaaagctgaacactgagcgaagtggtcgaacagaaacatgtcaagcgtttccgctttcacacgcataaagccgggcatttcatgcgtcctagtgcaaatgctacatcacggtctgctggcaaggccggcaactcgacccatttagcacccttataggcctttacttagactcttttgagcaacgcaacaacaaaaaggcaaccacatatctcaccaatctctccacctggcacacgttcgcatcaaatcattgcttcctacatagtgaccagttggcttgtgcaaggattagccatcacggtgcgctggctggttagctgcgtccatatcaaagcggctagcagcaagcatcggggatcatttcctttttcccgaaggccctgcatttccaaaccagaacctagaatatg

SEQ ID NO: 7327 - DNA, 700 bp, Nannochloropsis_gaditana
gggggagggagggtagcggcggcgggggctccccgtccaggagaagcgctaaccacactttgacgcgcattttgttgtcgacgatggtacccacaggatgattacgacaaaattgtttgattttgggcacgtccatgtctgttttgttgatttcagctcgaagttgcgcgctcaacatggtctaggaccccgctacgggctaatgatgtaccacgcaaacgttgatcgtagtgccgaaaagaccgccaacgcaaaaagcaagaccctgtcagtgcagaaattgatacatcacggacaattatcggttgattgacaggaatgtggccccgccacgtgaaataatttgtccaagccagcctatcaggggaaaggcccattgtgttgccctcacagcgagctctcagggagggatgaaaaaagcgatgtgggtggttagcgcctgccattcgagcctctattcgtgtcgtgtagtgttcccgcacggtcatcttggcattgttgtgatttataacgtggcatagcttgccaaggggcgggacgcgatgggctggtaattttattcgtcggcttgggagcttaatttctttgctctggtgtctcgaagatacacttggcatcgccgctcatccctatcgtgaacccaaccatcctccccactgcatacaggtaacacagggctaggtatccacgcagggaaatg

SEQ ID NO: 7328 - DNA, 700 bp, Nannochloropsis_gaditana
ccaaaattgttgttattatttctctctggcaatcaaggtttcgtcgcctatcatttgtttaatatgactatttactggatttttaacagtcgctgggatgctgtttataagtttgcattgcggtacgacgagcattctagtatggtgccccgtctggctttgtgaattcctctctgcgtactgtatttgtgtaccggttgagtgtacgcacacgccaaagcaaaatgaattgtggcgatggttacaatctcgccacctttatcgcggggaaaccctgcaaattggtggttgtcttggccttgaaacgctcgttttgtcgggagagcgtgtgtctatgtgtggataaagggtgctcaagctttaccgatacttgagcctcgaaaataccactgctctgtatgcatacaagtagttttaaaagtggtttctgggcagggataatagatttactgatgcattgggctctgtgaaaggctcacatgcttggaccctaactccgtcccttgctggttagatgcaaaccacgcgacaggtccgaggccaacgggtgcatgatggtgaaaagacatcggagacagaacgacgagcctttggttcgtcttggtccgtcgttgtctaccgccaagagtcatgctgctgtcatcgttgtagacgacagcagtgacgaggaatgtgaaggaggaagcagggaagcgtcatg

SEQ ID NO: 7329 - DNA, 700 bp, Nannochloropsis_gaditana
aggcttctatatacctgctccttgacctgattgaaggcgctcttccaagtgggcgttggcttgagcgatctgaggtatgaaagcttgaatcctagatagcactttacattgaaacgaataaataatgaaaacttatatcgagaatgttaaagattacgacgcgcgttgcgtttttgtacctacaggaagcagtgttgctgcgcagtgaagtaggaggaggtggcaaccgagcagaagccgggggggaaagcttatcggaggaatcagcggaagaatactcggacatgattgtccggcgtcaaaaataagtctgtacacagaatgggtaagcgcaggttaataatcgtgcagtggtacgaaagcatggcgcgtgggacctaaagcacatcatgtacagatgagacagaggcgacatagcaactgggcttgatattcaaaattttaaaaagatcaacctccgctttttgggtccctctccgaaggatggagctttttttcttccttcctttcgttgtttttttttattaaaaacgtcgaatgcgtgcgtaatttatttgagactccactaggcatgcttcctcaatatctctttcttataagcaaaaaatagggggcgtgctcattgatcacaacggggattcgacacagatctttgccttaaccctccccccctaacccatatatattaggctctgctatg

SEQ ID NO: 7330 - DNA, 700 bp, Nannochloropsis_gaditana; identical to SEQ ID NO: 4810

SEQ ID NO: 7331 - DNA, 700 bp, Nannochloropsis_gaditana
acgcccctccatcctcccaagaggccacggccccgcgtcactgccggcatttgggggggtaatcacgcccatgccaagtgaccgtacggcgagcccgatagtttcgtcgtatgcagagctaaagcctcaaagttcaaggggagggaaatgtccggctctgggagagcagcaatacactctgacgcgggcaataaccgggccgcctgcaccaaaccagacgtggtgccccaaatctcccgcgtgcaccatatgaacttcgtacatggagcgaccggattcgtgagacggcccggccacacgtcatgtggataggagaatggaccacggaacggcacggatggccacgtgtatttatccgcggagatttaaccttgttcttcctttctcattggccttccgctcgctgaggacacagcgagcggaggggatgccgagcaattcaattccccgtggtgctggctatgtgaagacaacttagagaatcatgtgggcagcgtcactcttacgattgtgtggaggcaaggcggtgtcagagaacccggacggtgcgccaaacagtggcattaaacgtatatcatgtctgccgccagcctaacacctcgaaagcctgatgctttcttcgcgccttattcctacaagtggtattcatgtcttagagcaagataaaagcgattggcttctcgatcatcacaacaaaatg

SEQ ID NO: 7332 - DNA, 426 bp, Nannochloropsis_gaditana
gatgcagcgttcttcggtatagcaggtccagaggtagcgtctatggatccacagcatcggttgttgcttgacgtttgttttcaatcttttcattcggttggatatggcaaagagtctctgttgaattcatttaccggggtattcgtaggtatttcaacaacagattggcttaagttagtaaataaccgtgttactgcttttaccggtctgggagcatcagcggcactggctgcgaatcgtatatcgtatgtatttggactcaaaggccctagctttattacggacactgcctgctcatccgcccttgtcgctttagatgctgcttctcaaaatcttgcgcggcggcgatgtgacatggccttcgtttccggcgtcaatcttatgcttcatccagctgcgtttgtaacgcattgtaaggcacggatg

SEQ ID NO: 7333 - DNA, 700 bp, Nannochloropsis_gaditana
cgcccatggcgacaagcgcttgtgcgatggcctagaaatgtaccacggattggacgcactggtcttgcaggactggatcaatggcgattatgtggcatcaatcgcagatgagatacatcatagtctggagtagctgtgcaatggacgggagaaagggggttcgaaattagatggtgacttcagtcgaggaatcaatgtgaagtgcgggtgacacccgcgattatcaaatattattcatgaaagtgaagacccaggtaaacgtgtgactcaaattaatgtcacacacatactccgcgtttatctttcctgtctgccggtcaaatggggcattttaccattttttggggtcccgacctcgaaattttggcgcgaaaacgtctggttgaagcccggttgccatgttgccggcgtctcagccaggcctctcgattacccccacacgttccaaacacggtacccctgcaccttttattcagcagaatctcgttttctcgcacgccgtgtacagggacaagactttgctcagcgggcacgactgtacgcagggaagtaacagtgaccaatggcgcgaatgaagcagcaccagcttcgacaccaccacgttctacgtgccgcatgtctgctgctgcttgtttcgattacgggcattgctgcattcaaactaccttacagtcattgcaattttgtccaaaatcacatg

SEQ ID NO: 7334 - DNA, 700 bp, Nannochloropsis_gaditana
  misc_feature (153)..(226): n is a, c, g, or t
gcggtttcctgactccggaaggccgggggagaaggtcggggaggagggcgagggcgaggaggagggcgagggcgaggaagggggatgggcaccggcagccaacgtacgggaaagcgccggaatccccgcctccttacgctcttccctccctcnnnnnnnnnnnnnnnnnnnnnnnnnnnnnnnnnnnnnnnnnnnnnnnnnnnnnnnnnnnnnnnnnnnnnnnnnnatgtggtggttgacctactacccaccctctttccttccctccctccctccgggggggagggcgggagcagtggatcggacggagaatcttttctttatcccggcttctttcctgtccatcacgctccttgccacctgggatgcctttgccctccctcaggaccgactcgggcgcccccaacaagaacaacgtgggcgcctccgggtatgcgtggaacagcatgagcggcgacggccttctccagaccttcaccaaggctggcttcggggccaggtggggtgggcggggagggtgatgctgctcgattctaggttgtagggggatatgcccttctagtgaggcagggaggatccacgagggtgccggtcctggtcttgtctccaccgtccctccctccctttctccctccctcactccctatgccgggcttgcccaccgtcttgcagggaggctgttctcctgtacggcgcgatg

SEQ ID NO: 7335 - DNA, 700 bp, Nannochloropsis_gaditana
gacgccgggatacagtgttgggtgctttcctgattgtctcgtatcatgggttctttcgccatttgcgacctaacaaagggaaagggaactctgctcgtttgttttgtccttaatgtaatgaggcagtgcctgaaaactcaacaagccgcagatgtacgtcgcctaaaaccaaagtttccttgaattcggcaatcgcattcatgacaggcttttcccgacaaatgattccctcacggcgttacacacggtggtaaatatatcgctgtacgtgctcccattgacgttccagtgctcgtcgcgctggcagtgtaggaggttattgacacaaactttgaaagcatgagaaatttgtctcaaagccccaagtaccgtcagatacacacacaccccacagtcttatctttctcaagctttcatatcgtccctcgcaccatttgaacaaaaagaatggtgtttccggtcgtgcgttccctcagtgttcctgttgctccgccggaagctcgacgccgctgtcgctttctctgcctcgccattaccgctcaaattgcaccataccactcactcacccgaagtccgtgtttttaacaacctcctggacgcataaatcacaggacgaaagcgtcctggggtgaacggaaaagatgccttaaaataatggggctcgtgccagccaggagaatttgagtcctttcttataatg

SEQ ID NO: 7336 - DNA, 700 bp, Nannochloropsis_gaditana
  misc_feature (1)..(591): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagatcatccccctccccgacgtgcacatccacccccgtagtgcgctggatgagttcctcgtcatcgcgtgcgacggggtgtgggacgtgttcagcaacgaggcgatg

SEQ ID NO: 7337 - DNA, 700 bp, Nannochloropsis_gaditana
gttgacttgagaaatcgtctggcatgattgaatggcgtgggcatgacgattttctcgccgtgggctcggtcgacaaggtggggcgatgctgtgacccagccgatgatgataatattgatgttgatgtcgtcctcgtttgccttctcagatgccattcggcggcaacgcgcgatgatgaaattatataggccgtgttgggaccttgaacatttttagaagctgtaattaccgggtaatatgcaatcatcatcactgtggcggcagcaataaagctgccatcaattctaggaaatgcaacaggtgcaattcgttgactactccgcttcctccgccgccgcactcccattgcagtgaaagtagccatacctgtttcaagcgtcatacatgagtcggcatgcgcgggaagtacggtgtgggcaggcccagaaaaaaggccaggggaaatggtgtcaaggcgagagacgttcgcacttgcgttcacttcaacttctctgttcgccgccccctagcccatggcctagagaggccgaaaaagaccaaaaccccagagatctttaaagctgacgagatatacatggagtgccaaatgtgtgtagagctcaagatgcatgccttacttttatactgccggaatttatggataaaagaatggaacgcattcttgtagtcaaccgccacgtcaaagaaaacttgtgtctgt

SEQ ID NO: 7338 - DNA, 700 bp, Nannochloropsis_gaditana
aatgatcaaacgcatgccatgctctacgacctcaaaaagatacgtggcattgttaccaaagtgccgggggggggggcggcggtatcttcccgagacaacgcacgcatccagcaagcaccacaaggagccaggaggttgactaccccatatgcctgccttgcgcttttcgacgaatcggccgatcagactgtttacgttcatgtttcccacggcttaaacgtcatctgatatgtgtcttgtcaagggttggagggttgggaataaacagatcctcaaggggttgcaagacaaaatcaaatcatatagcgcattaacatattattatttgaaaatgatccttttgcgcggctcgtgagctattcaggcgctcaatacatataacgtcttttagatgatactaaaagatctggatcatgtgactttcttgggcttaagatatgagtattaaattatttcttccttcctattgtagccctcactttccctgagcacagccatcttgaaggaagatgtccacgaaacgtggtggcggagccgtttccttatgcgaacttatgaaaaaaaaggtagggcgtgtcttctatttaggcgtcgttcagtcactccgtacatcacataaacgagaatctcgtgtagcttcagctatcgataatgtcgaagttgaaggaacctaaaatctggatggaaatgaaaaggaatg

SEQ ID NO: 7339 - DNA, 700 bp, Nannochloropsis_gaditana
gtattatccatgctgtgaatacccaacaaaaaagtgcgcgaatcaaacgaatttatcgtccttattaagagtcattcctgtaagacatccggaaaatacacctgagagtcgtactcagcgaaatacccacaagcgaccaattttacttgtctggctgcttcacaacaaaattacgtgtcaaaacgccgacccaaattccaaaggaagagttgttgagagctagaaattcaaactacggcatgctcttgaagggagtgatcgcactccctcatatttattcgccgcttttgcttatgcacccgggcatcgatcggtcccgtactttaactggggctacatttcgcatgttgttgaaaggatgtcgtcgacgaccgcaccatgttggggcggaggaaaccatggcgcgaagcaatttgtcttgtcacccgtcctggcaaaaaagaggaggggtcagctcgggacttgtttttgttgggtcgcctggaagtatttccccctgaaatacaacacttacctctctcccatttgatgatgtcacaaaagcacacaggaggacgcaaacgcgaaggaaacgatttgagctgagtgagtccaatcggcaaccttcctgactgacatcccgagcatcaaacattccctcacaagcctccagcatcaaaccgccggcatttcttcgacgtaccgtttttagaaagaaatg

SEQ ID NO: 7340 - DNA, 651 bp, Nannochloropsis_gaditana
gtcaagcatcatcggcatttaaagatcgattgtgtgaccttcgggtacgccgttcccatcgcttccctccctccctccctccctccctccctccctccctccctccctttcatccttccctcactctcatttctaccctgtgcatcgccccggcatcactcttcttggcgaaaaccacgctcttcttttctccatcgcgcattctcacttcttttctaccttcggggccactaacacacttccctcgctcacgtttacctcctctacctccctccctccccgtcttttggcccttccagctctccccaagtgggcgatcgcactttcacagatttcttgaatgccaacgtgaaccttcgacgagccgtttacgtcggttcgggtcaactgaacgagccggtccagcgaggcttgaactacggcatgggtgacgtcatcacccaggtacctgcgaacctcaacgcgtcccgtctcacggcccccaattaccttgcgcggtatgccaaaatccacggatattgtctactcacttgctttttttgcttcttctcgccacccccttgccctttttcttttcttccttccttccttccttccttccttccttcctccctccttccctcgctccctccccctctccctccccagatg

SEQ ID NO: 7341 - DNA, 700 bp, Nannochloropsis_gaditana
acacacttttggacacaaatgccaatttctacgaacatacctcatttaatacgtcaaattcacatagatacaggattttccataagagctaaagccattcaactcgtacacagtgcatgatctagttgatgcttactcagtctttggaatgctcaattcgcattgtaagcttttagtatcgaagttggcgaggacattggggacctctgctcgtcctcgcgagcacaattaagaaggcttatgtggatgaaggtggcagctcataaggtgggagtctcccaatcgacttgcgcctacctgtttattggcaatgtgaaggcaacattcggagccgatatcaatgcacgagttttgaagaaaccctcgataaagatactcttcctgtttattttttctgaatattttctcagggaacgtgaagtgtcaggtacacttctcagtctcctatggtcgaggccaaaacttatttgtcggagccgatacggaagctgaggctttcaggtacgaagtttgactgattacttgtacccaagacacaagcctactgcatggctcttatgtgcatcagaatgtgtatttttttagtagggattgtttgattgaccatctatgacagtttcaatccaagaaactgcatgtatcaatcattttcgtgcttcttgtatgggttgtcgtcacttgccagacgtgtggatgacaa

SEQ ID NO: 7342 - DNA, 700 bp, Nannochloropsis_gaditana
aggcccgcggatacgactttacgactacctgtccacggtcaaaacaacaacatgaggattttggatcatatgagcatgtggtccgcagagtttcgggattcattcttgcgacagacgcattcgatcttttggtggttgaagacacgtgagggaagtcacgtcggaacagagcgctgcagagcatttgctttcagatttctgagggcaactgtccgctagaaatcatgtgcctgccaattcgctttatgcacgtagcttaggcacaagaattaagcatcaggaacattcaaatgcatcgtccgtgccaaaaatcgaccagcaagtcgctggtctgtccgccaaaacctgccgaccgggcccgagggacgtgaacctccccctctcctcgtctcgcgaacacgcatcccgtcacttccacgggattaccttgattttcgcgcaaagcacacgacgagtcgtgtaacaatttgagtctttatatgatcggatgtacatctgctcatctacttggcgctttacccaggcacagcaaagcatccatccctcaccatgtcgctacactcccgcccataaagccgtaggagcacgagctctaagagccccgcaacaatatatataaggacatcaaaatcctgatttttttattccttgccttagctaaatcttacaggaagcacttgaagtgactgagttgggaatg

SEQ ID NO: 7343 - DNA, 700 bp, Nannochloropsis_gaditana
ccacagtgcaaaaagtgtcaatttgaacaattgtgtagtaggcgtgacagaagatcagcgaacccgccgagcggcgctctccgcctgagcccttgcttatgcccccgcgccgcaaaaaccttaccgtaggaatacgaacgcaccgaatttttctcatttgttcaaaaactacttaagagaatggtaactcttgtctgcttcgagacggaagtactgataatttgccgtgacgcgaggcaaaggtaaagggcagtgcggtgtagcttcattatgctacacggaacaaatgtaacacccttcatttaaatcatgggtaaggtactacttgcctctttcaggacgtgatggacaatgacatatattatcatgaagtgtgcggtgttgttcggccaaacttatcacgcccctacatggaatggggggctccagtgtacgctgatccccgtcacgtggaacatggtgtctttaagtaccgtgggctcgttgaagggacgcaatactttgatgcggctcataaacgagctcttaaaaagcagttttgtggtctctttctccgcgaacttgccgcaggtcgaaatgcgctcagggacgccgcttcggataaatcgtgtggccgactcccgcgttgcccctgtgaacgaatctcacgcccgctctcgcccacgtgccccgcacagcaaatttggctacgctaaagatg

SEQ ID NO: 7344 - DNA, 700 bp, Nannochloropsis_gaditana
atggaagaatgtttgtgttgagatggccatccaggggcctaagacgggacgcaggagtcaagcaaaaggtaattcgtgttgggccgtcgccaagcccgtctggcgacagggggggaggcgaggcgtgaaagaggcggggacgaggacgataggggacggacatcctgctccctcgacccgcaagaacacatttcgcacggtagactgggccttttgagcgcgagtcgtcgtgaagctttggtttctcggttttggtttctgtggtatgagctacgacacgttggcatgcagggcctcggtcgaggtcctccccttggatgtctccaagcatggcactagcaaggtcaagaagtgtgtgcaacatattcttttgatgaaatgtgatgaacaatcttcagacttacacaattgaagggctggtcatgctttttgaacgattgaaggcacccacacgtattgctccatcgccgtatgtaattcaccgcgcataatgcccccaaaaacacagagcctgcagagttagtgtgcgcagtgccgaaaataggaagaacagcaactggtgggaaataaaagagggagagcggcgcgtgggtgacccatccatcgcccgctcccggccaagtcctctcgcctcgcacagccctgacgccgctgctcacgcctcgcttctcctcccagcaacctctatatcatcagtatg

SEQ ID NO: 7345 - DNA, 700 bp, Nannochloropsis_gaditana
ttcgaacccaccgtgttgcttgtcatttatttccgtcactactaacaagcattatagcgacaatggcttagggctttgatctaggcaaggggagggaggaggtaattgactagatgtgcttgtccatgcagtacataagagaaagaaacgcaggcgcaagtggcacgccaacagaactgcgcagcatgcacgcgtcgttgttttcatccactttctctgcttgaagcgcgattgtcctgtgcatgtcatctcaaggaccatgccagacccagcgaggaacagggagagtgacgcttgcacgggccgcgagtccgaatgcctgtctcctgcgtaggggttccctgcctccctatccagatcaatttatacgtgaaagtggttactgttgactttctcctacccagaatcactccggtacatttgcccaactcgactcatgcgcagatccctcgcccgatcttgcccctctcccccctcgcagcatcagctcgacagaggatcgaggcgaccctccatcatgcggacagcccggtcctgccttaccctggccatgtccttagtcagtctggtattgactacgacaccagctatggcattcttcaacgcgggggtctgcaggcaatttggaaccttacaacccttccgtcctccccaacccactttatccgtctccgcccggcgcgcagccgtggtgatgatg

SEQ ID NO: 7346 - DNA, 700 bp, Nannochloropsis_gaditana
gatatcagaaactctgtgaacacggaatttctaggcgcctcttggatctgaacgaagactactcaatgtgtatgtatgatgattttatcataaattatgcgggttggtggggtgcgaatcctgctgctttgcacggtcccaagacttcatgaatagggcgtggggcgcgggctgcgtcatcccgtccatgattccgtgcccggccgcgcttggaggctatagatggatggacgttgttcttattgcctttgccagcttcggaatgaaccacgaggcttcatgtccatggcagctttaagatgaggtcggatggcgtagaacaaaaggatgcgtcgcctccagacagggacgaagaagattaagatcgaggcccggtagacctggcctcagtttcaagctcatttgagagactgcaggagatacggcgaaaactcacatctcagtctcacacataaaagaggttgagaaatactgccgtcctggacttcgtattcgtcgctttgtgtgacaagactgcgccagagagcgggatcagagcgacccctcaacgaacgaccgggcggaaagcctccttgacgtgcagcccactccgtggccatcgagctcaaaatatgccacagcaatcgaagttggtgtcgcgtgggcaggcgtccgcacgggaggaaaattggttcgagtacatgatcacgcaccatcgatg

SEQ ID NO: 7347 - DNA, 700 bp, Nannochloropsis_gaditana
ggactggacaatccaatgtaccgaaaaggatgcccagatcttcagacggatccagcgaacgtgcgctcgtacacgctttccgaccagtcgtgtgttacacaatattgaataagaagatgccgataaaacaatacagggagtcacaatagttggggaatcgcaaaacccttatgaacgcaaacaacaaatggaagtgtttaactcacggtgctaaacgcacagagaaaaagacgagtatttttttccctttgcactttatataagatgtatcttctagacacagtgcatttatgctaaataatggctcatgtaaacaacgtcgagggtggccatggcattcgtcagtggcctttctactatggcagagtgatgggaaaataacctcctgcctcctgggcagacaggctcgattgttcttgatgtgacacgaaacctgcgcacggcagcaatgccgagatgcactgctagtcatcagtatcacatcgcaaacctcttatatttttggaattaacctgatttatgtggctcacgaattaccctgcgactgttctgtccctcagttgcaagctcctaccagtatgccgcctgggcccgtctgctctacctcctccagaccaaacctctcgtgtttgcctgactgaaatttcggactttagtgtgaggtatacatcaggagctcagcgctcacggtgccgcaatg

SEQ ID NO: 7348 - DNA, 700 bp, Nannochloropsis_gaditana
cgtcgcggtggcccactccttcctgaacgtctatgcccgccaccctcgcgtggacgtggaggggcacctgaggctcttgcaggactcgcccgccgaaagcctcctcctcgacctccagccccttgggagcgccgggggccgggtcggccaggaggatgacccggtcctcagcaacttgtccgtcaccgtgctcctggatcccttgggggaggcggcgcagcgtctggcccccatcttgaccactctgcgcgaccatttccacctgcccctccgagtcctcctcgcgccccacccggagctcagcgagtttcctctcaagagctactaccgattcgcccttttccccacccgcgagacgcatgtcctcttccagtccctccccccctccctggttctcaccacccgcgtcgacacccccgaggcctggaacgtgcaaacccgccaggcgctccaggatctggacaacctgaagtgcgagcaaggggagacagggcttgtctgcggagacagggagggatccagccacacgtccgccgagttggtgctcaaaaacctgttggtctcgggccagtgcttcgacgccaagctcttggagccggtgaacgggctgcagcttgtgttggtggacggcttggagggggcagagggcggggaggagacggccggccggcgccagcaccactccgacaccttggtcatg

SEQ ID NO: 7349 - DNA, 700 bp, Nannochloropsis_gaditana
atgagtacgccttcaacgcccattccgtcttcaccgtcattgccacctacgtccgcgtgacgaacgacacagccctcctcgacttgaaaatcgggaccgcggagagagggaaaggaaaaatgacggtgggccagcggctggaggaggtggcgctggattggaggcgtcgacgcgtgcccaaacccggaagcaaagggagggaatcagaggcggggcgtgctgggccgatgcctggtggcgggctcaggacgatgagtggcagcgacgcggaagctgttgaggaccgagagataatgtcatggcactggccgggggacaggaggcgcagttgcaacactagaacgagtgggagcgaggaatttgcagagtcgccgcctccaaaaggtgtaggggggttggagggagcggtgggcactgtagacgaggacggggtctccaggggggaaagagctccagaagacgacgaggacgatgatggatatttttatatcgcagactacggcccgcgcccagaaaacttcctggaatgcgtccctacctacatccatgtggtcccggcgctccaagctgccaacgtcgaaataacggcctccctcgctacgctgcggtccgcggagggcaatcgctcaggcgcggtgagattggcaaagatggcccggcggttggcgagagagactgtggagcacctctacatgcccgg

SEQ ID NO: 7350 - DNA, 700 bp, Nannochloropsis_gaditana
  misc_feature (1)..(669): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccttcagcaaagagcatgtggtggtgatg

SEQ ID NO: 7351 - DNA, 700 bp, Nannochloropsis_gaditana
caaatcttcaggttcaacttgctgcgttcccattcccccgcgccgtcctggatgcattcagagtttgctgggcccgcaataggttgaattggatggtatggaggacaaagttggcctgagcaacgagaatttggagcgttgttggtgccaaaagctgtcaaatagggtccttgaagagggtcttcttgaacaagaacctagcatgcgcccacgttcttttacccctgtacacgcttctgtttgttacttctgctctgtcgttctttatttccgcatgcttgctaactgtctatataccttgtatgagcgtgcgcgacaaggttgataggattaggactggcccctgtctttgttctgttcattcttaacgccactcgggacgtgtttcgggcgactcattgacctggtgtgcgatcttatttttgattttctgtagccctcttaaatgtttttccatgagaaattatacacctgaagatcatcgtccatcttgttcggcacactttctctagcgaccttgtgtgtacgcgaatgcgtgtccgggatatcgcatgcttgtttcaccttacaccctggtccatgattgaaatgtcaagattttggttcatctaggacggctctaccttatatctcacgagaacaaccacaactcacatctgtcaacagaagtctccactttaaaacttttctcataataatg

SEQ ID NO: 7352 - DNA, 700 bp, Nannochloropsis_gaditana
tctcgatctgtcaaatcacacgcagaagattcctttttactggcagactgcgtcgaagggcgtgctgcccgtgcagcaatgccgctgtacagagagaggagaaacgtgtggaagagagattgtggtgctgggtgttcactactcagatgaggatgataatgccgcctgaagcaaacgtcgcgccactcaacgtatgctgcaacgtttatcacgcgaattgtattcacacttttaacccctcaccctgagaaaaaacgcatgaggattgaaaatcttgcacgcgatatgaaaatccgggggcaacgggtttcagtaggctcctctccttgaagcaaggacggaggggggcgaaggcgaccaaagccagtacgaattgctcctttgtattaatcggacacaatcaaggtattcgtgtccacgtatgttgcaacagaagacaacgaaatgtatgagtgaagcgctgtgcgaagggaacgagtggtcattatcatgctttcgacggcgctttcagcaatacggctacggctcgtcagcatcattatgatgtatccttccttggcgacaacagaggactcccgccacccgaaataatacttgggtggaagaacctgtgaaccccaacacctctttccctgtacattttcgacacgcttgaaacagtcaaaagtgccgggcaaatttcgctggtgtggtcaagatg

SEQ ID NO: 7353 - DNA, 700 bp, Nannochloropsis_gaditana
accctgccttctggtcggttggttccatggaagtgccacacgtggggtatcgaggccgtgaaaggcaactcgaccttctgtgccgtgcttcgaagggtcgtgaacgccgttttttccacgatgggtggactttgtggatgtgagctggccttgaaggcttgcgctcggcgcgggggtcctgctgagtgccacctcactcactggactatgacataaaggtgggccctcgtcaccacccagggcggttgctccaggatccaacgcggtcgaaacccattttctccgtgagcataagttctttgttgcgtggtttcccatgcgtgcgcctttcatgggtgtaaatgtctagttttgtgtgaagtatttttttttgcagtcggaatgatgaggagaatgcaagcacagaatcctctcactcgagaccacctgaacattcaaccccgtgttcaatccagtagtgtgcgaccctctcacgccatcttctttcccttcttgtcctccatatacatacacacatgtttcaaaatacatctgtctgctttttggttcttagtggccagcaccagaatcggtaaacactacctttgagtatcgtcgtcgctgtcgtcgaccataagcgtacctttctcgcgggccccaaccaagcgacacataaaaaacaatcaccaccaactggaacagtgcggtcttgccttgtatg

SEQ ID NO: 7354 - DNA, 700 bp, Nannochloropsis_gaditana
  misc_feature (224)..(233): n is a, c, g, or t
gagcaggcggagcagttgacggccctggaggaagtgttggcgcgggagcggaagatacggggcttaaggaaggtgtaccacctgatggggagggagggggaagggaggagaagaaggaagctgactcggggggggaacagaaatcgacagggcgggggaggggaggaaaggggagagggggaggaaggggaggaggaggaggaggacgaaaaagaagcgatgcnnnnnnnnnnttggttcatctttttgaaccccccccaccccccccccaaaaatcgagccagccctgcttcctttcccacatgcacacgatcgtaaggtctttctttcacgccgagggctttgcccggcattcgcaccacttttgttcccacgaatttcccttctctcacaatgtagggagtctaacttcacgcgcaagcgaagcagtaccggaatcaaaacctttaatcagtgtgggcgccgtcatctctattcggtagtgccctcgcgcccattccttcgaagccttcacagcactgaagtgccacaaaagtcaataagagccgaagcatcaagataacttcacgcaccacaaatgtctgcgtctttgcgccgaccctttttcctccatcttggcccctttctagtcgtcgcctcgttactccttcattactatcccactgccggggtgaccgctctggtttgcccgaaagaaatg

SEQ ID NO: 7355 - DNA, 700 bp, Nannochloropsis_gaditana
accgattcgtccatccccatttccttcctacgaaatagcacggggctgtcctcgcatcttcgcagtcatcctggacattatcagagcaggcgagcctgatggcattttttgggccgccataaatggaggattcaccctctgatgcttgataccagagcgctctgacgggatgggttgaagcgtcgccggaaaggagacactggcgcgcgtcgtacctaaatcccccaaacaggcggtgcatacggcgtgcttgcgcgacaaatggctgggaaaggagcgaaaggaacggtataatctttgagtgaggtacaaccggcttttattctttacgtggttggctccatgtcttttgcaagccctcaatctttaagaacagaccttcgaagcaattatgtctttcttcatcgaagtggcgtgcgtgtgcggcgataccttcggaaatgtgacatgtgtacatggatgccctgtcatctttgtaccattgattttcaggctttcgacaccgcacaacctgaggtccctcattaccaagcttctaccatcatgacttcgggcccctcttacctcctcgccgcacgtgtaacccataccatctggctcacgccactcgtccactcgtttcaaaccaagctctatccaggctcgtgcccgcactcatctcttgcttacctcgctggtagagccagccaggaatgtgatg

SEQ ID NO: 7356 - DNA, 700 bp, Nannochloropsis_gaditana
cttgcatgtcggtctacatcttgcactcacgaccgatttgttttcatcatccctgtcatatccgctctgtctgtcgtggaaagcctttgtcggaaatgcctatttgcgacaggcggtgggaatttcctctcactagatgccctgtttcctccattttcgagatgggaacgagcgagaggcggaacgtgtagactagaaggcctccttttataggggctatatatcacccgtgccgcgtgtgtatggtgtgccacagccttttaaacatgtcttttcacctgtgactaaccttaggacgttgtctttgcgccaaccgagacggaggcggctgactgtttaaaaggagcggaaggggaatctgaccattgcccgtcgaagagtcatccagacagcgccgctactctaccgaaaacatactaatttacccttcattggatagaaggcaaagcggcaggagcagatccagacaaagatgggaggtgcggcgtcaaagaatgtcaggacggagcacttgtaagtggaaaaaccgatgcatctgagcgattgcctgacggattagcaacccgcttttgccaagagcttctgcaagatcgtgtgtgtgaccttcgacctatcagagggatggacagattttttgtcatccgcctcttgtgttcgcaaggctcattttggttttttttctctcttttccgattcgatg

SEQ ID NO: 7357 - DNA, 700 bp, Nannochloropsis_gaditana
tttggccgcgtactccttgactatggctcgaacacctgccgcacgacgctgcaacagatcctctttgtgcttactgacctcatccaattgtcgttgcacatcttgacgtcgagctttgacttgctcgaaagtatttttcccagttgccttcaggaccgcgcgcgcatctgccactacttccttcaacatttttcccgatgtggtgtttcccattaggacgccaaaaggcaaagccaaagctttaccgctctccccgtcactcacttcgcactgcctgtttgatgcacgtgcatacttatgcatgatgacggtgtatttcttctgcaagcggagcatggtctcggtgtgtgcgccctggcgtggacatgagggaggtcactcggcgacaacttgtaggtgacgaggatctgcctggcgcccgtccgcgtttaaagctatcctaaaatctgtatgtgcaacccatcggcaagcctcttcaccgccgccatcatcctcacacatgcattcactagcacgcctgcactaacgcgtttaaacacaggcttgcggaccagggaggacgagactcgggtgttgtctggcgcccctctaggagcgtctgccctgtcctgccggcttgagaagccaaggtcttcatatctccaagtcgccacgttcgttcagaccccctttgccacttcgtgagcttcgtgttgccatg

SEQ ID NO: 7358 - DNA, 700 bp, Nannochloropsis_gaditana
aatttcttatcattttaaccggttgcaagggcgtgttttcctgtccttgagctctaggctgtcacccaacccacctccttccgatttgtgctcatgacacgtgagggcaatagatacttttgcgtcacgctcaaacaaacaactggacatttgaagaagcctgcaggtcacacaccctgcatacgcggaagcacagaccacatggctgcacttggccgaaaagggcctttaagaaggagtgtcccgggccgggaaggaaaaagcgaggcaggttgccgtaggacacatatcattagaaatgacacaccgccatgccccgggatggtgcgctttctcgaacactcggtaaggatggcctgattatgacgataaatcccttttgaagctttcaacatggtgcatcctcgatttttaacccttgttgcaaagtcggacacgacgacgccgccaaagcctccttgaggtgctacacacgccatgtctcttgaagtaaacaggcagtgagttcacgtatgtctctctgacttgaggggcgacgtcatgcgtgtataatggcagcatagatattatgcgttagaatagcacgggtgctatgctttggatggccacagggtgcttttagaccatttggagggatgaagttcactcacaacttcttccttcctgtcacccagcgacttttgtttaggtactcgccatg

SEQ ID NO: 7359 - DNA, 700 bp, Nannochloropsis_gaditana
ggaagggcgctcaggagggtgagggcgccagaatagcgtggaaatccatgcatatcggacgcgccgatggaggaatccactgttgccgagcaggagggcttgccttttgttttttgtggaatttctcgcgtatgggccagggatgactgggaaagctgtatcacgagctgatgcgcccgagtgggattgcggatagagcggggccgaggtcacagaggaaggccgtaggacgcgtcgacgggcttgacctggtgttgtttggaatgattgggtgacgaggatcagatgcatcgcaggaggcgggggggagatgacggaggggtgggatggctctggtatcacggatggagggaaaggtcgatgccaagaccggtgatcggatcaaaattcacgtttttctttggaaacgaaggctcaaatactgttaactatagacacaagagaagtatggatggattgacaaagctttgcaggatgaaccgacggctaaaacgcaaaaaggcaaaagaaatcgtttcgatggagatggaaaagcagacacccctgcctccttcaccttgaaaggatggtctcaaacgtcttttaccccttgctgcgggcacaggcaaacagtgctgctctccaaaaataatgctttcgatcccacctaatgtgcaacggggccatttccagccggagcagaccttagtgagtcactccg

SEQ ID NO: 7360 - DNA, 692 bp, Nannochloropsis_gaditana
  misc_feature (537)..(676): n is a, c, g, or t
tccgtaccaatccgtcagagccgttccacacctccaccggcacgcccacccacgccccgtcccgcagcgagcccgccctgacgcaagaccccccccctcccctcccccccttcctcccccgcgctctccaacgaggacgtctcgatcggcggaggtcgaggaagcgcccgcccgctctcctgtcctccttctctcccctccctcccttcctcctcctcttcctcctcctcctccttccaccccacgaaccctcgccactgcctccaccaccaggccggcagcaccgcccacacgtccccaggctccgagcccagccttccggtctgcatcagcagccgtcgcacgatcagggcctgctccgcgggggagggtgctgaaccccctcgcgggagggctcccaagccgttctggttgccgtcggcggttccggcgggcgggtagatgggggcggagggggatgagtctgcccatgcagcttctccggaaccccccaaggatatgcgagaagcgctctgtccgttcgttacctcttcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcttgatgagcatg

SEQ ID NO: 7361 - DNA, 161 bp, Nannochloropsis_gaditana
gtaaaggcaagagcgaataagaggcggacgtgcgagaatgcgagggcggagaagggtatcgacctgtagacgaatttgcaaaaggcagttactcgtcctccaaaaccctgctcctgccttcctcccttcccttttcccttttccctcttcttccacagcct

SEQ ID NO: 7362 - DNA, 700 bp, Nannochloropsis_gaditana
accttttccctggatctccttcccccacatctcaattcttattcatatctctctctcgtagttctccatgcgcgagttctgtgttttcggagagagatcagctcgttgaaagtggtatttgtcagagttatactacattatttatagagatttcaactcgtcgaaactggtgtttgtcatagggacaacgtgttgtcatagtgaatacaaaaagaggcttcggttcgtcaaaagtagtatgtgtcgtgtaaagggcatcttttcaggaatacgaatttcatcttcggaactttttgacgcgagcgccgcagagaacggggggcatagttccgttggggacggcttctgtgtgttccgaccggtgtgtcctgtattctgccttgtaagcgtacatctcatctttttcccatggaatatcgcagaatggtttccattacgtgatagcccttttgacttgcacctgtgatgccctgcaccttgctacaatacaacgtggtacttgaggtcctgttcttttctgagagttgtagtccgttggagtcagattttggcccatgtcacccacaccatattgagatttgggcccatatcacccacaccatattggatcgatgcacgatgtccaagtgatcttcctcattccctactgactaccttcacgctccagtgtattccattatacctagaataagtatccatg

SEQ ID NO: 7363 - DNA, 700 bp, Nannochloropsis_gaditana
aacattcctgttttccctccccgcctcacacccctcaaatgaacgtcctgttcttgtcaccatgcccataccattgatgtatggctgttggggtacgtgggaactaataccacgtgtctggtggcatgcgtgtgccttgtattggttggaaagtctccgatctcccgcatcgcaagaggtgatgtcttatcccatgtcgattttttcctcacccctcaaaactccttctatcattgccccacctgcctaccactaggccatgtcggaatcgtatcgaagagcagtaggaggacgcctcaagatcggtgggaaagaggtggatgtgtaagtaaagactgggggaatgtggggtggggcaagggcgggagctgacataggtgagacgtcgcagacatcatggtatggcggtcagcacgcgacacaaagaatgagacagtcctgctcatttcgtgaatcatggcgaaggttccggtgctcattttcaaggggaagagggaggccgtcgccgatgtattgaacatcaagtcgcaagcacgagtcttccttctgcctctgattatatctgtcctcgagtacccgcaaagtgcatgtctcaattcttctgtgacataagagagcgttagctagccctgtactgtatcttacatgttccttttcctctccgcctcccttcttgggggttctccctccttctcaaatg

SEQ ID NO: 7364 - DNA, 700 bp, Nannochloropsis_gaditana
  misc_feature (1)..(621): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatccagaaaatcaccgtcaaccaggagacgaagcacaccacggaaggaactgtctacgctcatctcttcaacgatg

SEQ ID NO: 7365 - DNA, 700 bp, Nannochloropsis_gaditana
tcatggttttcatggtcccgtctgctgccttgtattcaatgaggggcccatctccgtccgtcacagggtgttgctttacccggtcaaaagccctcttagcatccaaatgttccttccgagagagagtgggctcagccgcagccattactgaaggcgcgcatgtgtataaatgtgttgcaaatgaagctcgcacgattgaagtcaagctcacacatgttatgatccgtacctgaagtgaggctgatgcttacaagaagcacgagcaacaaaacaaagactgacgcgctagggcatgttcccatgggttcctgatgtacgattgtgcgtcaaagagctgtgtagtccttattggctttggtcacgctggcaaatattagaaaaggtggccggtaagtcaagtcttcaggggacgcaggagaaggagcgaggtgagcaagaaaaagcgacgacccctcggaactttcagcccattgccgcatcccccacacccaattcccacgcccattcgcacagtgggagacgagccccagttatgtggcggccacttcccttggttgtcttattctgggcctggaccgcgtggggtttttcctctccgctacttcctgacgcccttctcgcggctcgcccacgcagccgcggcccgcgacatgccagcgcgagctatgcgggaaggaaaagcacgagtccttttacaatg

SEQ ID NO: 7366 - DNA, 700 bp, Nannochloropsis_gaditana
ggtcggtttgcagcatccgaagttgctgtgctgtgaaaggatgctcccacatgtgcgtgttcatggcgggagccaatagcacaggcttctgctttaaatcccaagcccgaacaatgctcgtaacgaggttatcgcagaggccgtgagccagtttccccagtgtattggccgataagggggcgatcaggagaaggtcagcccagtcccgaagctggatgtgtaagaccgggtcccccattgcagtccaggcgtcccactcattcttgtcctccagtacttccacccttcctcccagttcctggaaagaggcccatgctgcggggttgtacaccttcgcacactcccagaagtgccgtgctgccttcgtgagagcgaccttcacctcggcgccagcgccaagggataggcgcagcgccaattccggaattttgaccgtcgcgacacttcccgtggcggcaagaaggactcttggtcgcctctgagaacgatgccgtgccgcagacatgccacctgtgctcgtagggcgtgcgcgtgagaggggggggggaggtttgcggggcacgtccaggaaaagcgacgcaggcgaagggcttaccaccgtcacatatcttgcccctcctcctgtcgaccgtgcgacaggcacgtgttcactcaagaatgctcaaaattccctttaatgtcttcctactggtctaggatg

SEQ ID NO: 7367 - DNA, 700 bp, Nannochloropsis_gaditana
  misc_feature (1)..(379): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcgagacccctcgaggagagtttaatctcttgtacattttcgattgagcgtgtcttgcgttggttatggacatggaatgaaaatttttacgtgttgaaattcttgatagcctgttcgtagtgtcagcatttgatggtgaaaccaaatattactcatttgaacaaacaggcatccatcctcctttcccccactcctccccctccccctcaccgcctccatgtaactgacctctccctcctctcctgtctaacttatgtatatttttcatctgtttgcattcatgcctctaggaacaaggagccctgtgaaagaggccatg

SEQ ID NO: 7368 - DNA, 700 bp, Nannochloropsis_gaditana
gtgaaaggatggagcggtcgagccggtgcgttcttcatcgataggaagagcaaatttttaaccttaatatgtctttatcttcatcagcaaatgccaacaccctgaatcaacacttatcaagattgtagacatttctttacacacaccctggcggccatgtaggaatatgtatcccacaaaattgattttttaataacctccccctttgttcctcgctcctcctttgcttcaagccaccaacctcctccccataaaaatataccttgaaaggacacaatttcgtacgaagtcatgcatggctccgtgcagacgttggtgcttttcagtgggcaagtgtaaacgaacactaatgacgattgaacccagcttgcattgtgatgaagcttaattgctctgttcgacagatctacttgctacgtttctttctctaataaccaaccttgtccaaacctttcaaaaatataaaccccagacaagacagtatctcggcatcaaatcacggtacacgtacaacctcgtcgggggtgaacgcgacatcatcgcccccgaaaaaactggcaaggcattcctcttgcagctgtctagtgccctttcttctccttgcgacgatttccttcctgatcgaccttggcagtaccgtccaatttttcactacaattcgtagcattatccaatatcaacaaaatcaattgccaagctt

SEQ ID NO: 7369 - DNA, 700 bp, Nannochloropsis_gaditana
ggcagctattgctggtttgatgctcatggcttgctatcgactcttcgggaagacgtcctcaacaaacattattaaggatccaaagccttcgaatgagatcgaggaattcccttttgacgagaattccttctccgaagcttatggcgatagcttcgagctttttcgtccttggtacgctatttcctccggcatacatcaggtccccaagcttttggcgccaccagagtcttggattgagcaattgagcctcagacttaattatttggactccaaagttagcgcggacactgatcgatccgtattgacacgtgccagggctgcttatcttgagtttatgaagcggtacgtgtcaggactagcgtatgggcccgaagagctaagtgtgtcatatggtggtgttttgcgtccgtttcagcctggtaagagggcacagggtctggactgggcttacctcggtgtgaccatgaccggcgagctccgccttgacaatgtcaggctcttgctggaggacgtggtatctagaaacatcccaggggactatatagagaccggggtatggcggggaggatcatccatttttgcgcgtgctgtgctgcggagtctcaatgagggcggtcgaatgtcatatgtctgcgactcttttaagggtctgccacccggagataagaatttaattccctctgatcggaattggaatatg

SEQ ID NO: 7370 - DNA, 700 bp, Nannochloropsis_gaditana
tcggctcttctcagcgctcgaaccctgccctccttccatacctctacgcggcgtcagactccaccgcctcctctatctccgctaccgcttcctcctctgtcccctcttcccaacaggtgcactgattgctcactgctctttccctccttccctccccatgcggtccctgcccctcccggctccgggacgcatactgactggcaagccctttgatgtgcactcatgccggcgggtcttggtcctcctcccgtccctctttccctccctcattccctctagtctccttcccagcaaaaccaacgcttcgcctccgcaaggatcgccggtgccaccattgcgtcttgctttcccaccctccaccaagctgtactagccacaggagcaggtgtgccccccctcctttccctttccccctctttccctctggtcctcgcttccttattcgctctcctaccccaatttctctttcttgtctcttttcctgtgaccttctcttctgtgtgttgcttttgccacattgctactacctcacccctcctcccgccctcctgtgctacttcctccacgaacatgagtccaacgcattctaccactccgtccctcgtttctcttccgtcttcctctccctccttccctccttccttcgggtgtacctccaggttttcctttcgtcatcattgacgaggcctctcagctcatg

SEQ ID NO: 7371 - DNA, 700 bp, Nannochloropsis_gaditana
cttcgctgtaacgtctttactatcaataccagccagagcgttgggaactggcggacacatgactttgaaccgagcacatttcgtgcataacgtttgcatcaagtttttcacggcgcttcaactcttcacctttttaaagttgacaatatatactttgacgctctttggtcatggtttcggtatcggagtagccgccgccccggccacgacgtcttgcaatcccacatctccttgcgcggagaacggttctctcgcagtgaagaacatactgtacataatcatagacgatttgacggccgatttgtcactttttggtggaaaaatagatcaagctcccattcctaatctgcaacatcgacttgctcctcgtgccgtgaactttctgcgtgcgtatgcacagcaaagcgtgtgcgggccttcgcgcaattcatttctctcagggcggcatcccgacgagacacagtcctacacgtttaaaacgagcttccgggacactttgcccgacgctgtgtctctacctcaagccttcaaaaacgcgggctacttgacctgtggcttcgggaagaccttccacgacgacgggattccaagcccgccggactacgacaatccgtacagttggtccccagagtgcccatactacgctcctgaagaagatttttgtggggaaggtcagcatggttggtgcactcccgacatg

SEQ ID NO: 7372 - DNA, 279 bp, Nannochloropsis_gaditana
ttctcctcctcctctccctcgtcctcctcctcctcctcctcctcctcagcaagggcttgcccgtcctccatgatcctgtccgtgctacgtctgttcaagtggctggtttgtcagagtacaaccggagggaagtgaagttggtgggaggaccgcccgtgtgctcgctgtcgatcctttgttacttatcgcttcggtaggtatcacctcctgcccccgcgttaatcctcaacgtcccggctacaagacttcccacggctggcgcacttccctcacaggatg

SEQ ID NO: 7373 - DNA, 700 bp, Nannochloropsis_gaditana
ttggtacgacaggcaaagaatcttttactctaccaatacggcccatgcgggaacttgcaaagacaaaagagtttcctgtccgcgacggagcgtctcagttccggcgacgggattccttacgaagccccgagcaaccacgcaggaaacacgctgcttgccaacaccgaagaattgtatcactgcgctcttgcactcagcacgagttaggtgcacatcaagccacgtggccactctctgtcaccattgattcttccctctgaattgaaataaatccagtacccactccgtcagtcccaacctcctggtcgaaacggaccaaaagatctaaaagaaccattttcttgaaaacgtccgtgcgctcttttacaagtgcacccccttcgccctctttgcaggcgtgcatgagcacgaacaaatatttaccctgtgcatgtgcaggatgggcaggagccttttgacgtcttgaaggtggtaatgtgcatcattgaggagcaatcttttccatcgaagcggtctatttattcttcctcttcatttttgtcagttcagcaggatcggtgcatgcgcattgggctgtcccacttactccgtccacgccatctttcaatacgcagcagttttctaggtgcgtcgtgtagaccttcgtgcgcctgattttgcacgcttttggtgtgcttggctcgggcgcacttggcgcatg

SEQ ID NO: 7374 - DNA, 700 bp, Nannochloropsis_gaditana
gggacagctgcccagacccgaaactccaagggctgtttttggatgtcctccaccatgttttgcacattcccgctattgatgagcagccagggcaagtccacgagcacgtagagaagagcggcgagcgggtagaaaggccagcctgggctcttacgtcgcatggccacctcgctccattccaatgtctcgctttggacagactgatacatgagctttgaagtggcactctttatccgcgtccgtgcctaggtcgtagaggaaatgaaggaggaccacggtgtcactttcagtttgccacaatcctgagggctttcgcaggggccacgggtgtgcgcgcaataaaatcaatgcaaagaggagaaaaactgtctaaaaaaggtcaggtgcaagccacgcaagcaacgaggggcttttgcgtggtgcagacgacgctcgcccgcatggtatgctctgagtcgctattggaacatactcgacgaacagcaccccccatctctcgcatgacacgtaaaacctgcaccacattgttacctgattccgagagacgtctcactttacaaatccgcataacaaacacctaggatgacacacatacaatcagcttggtaaggcgaggcctaagacccgtgcttaagctgcgggagcctagcagatacttttcgagccggtaaaaagcgactcctgcgttgaagaagacatg

SEQ ID NO: 7375 - DNA, 700 bp, Nannochloropsis_gaditana
tttgctctgtactcccttaaaacaacaggtgcaggaacaaagggaagcctgaagtggtcagtcgttgttttttctgttgtatcctaccacgccattctcgtcgaagtcatgggtaagtcagaggtcaggttgacggaagagggggaacaatagagaagggataaaatacaagcgcgattggactttaatgagcttcgaaacgcagttaaatgaaacgcttgtagcgttgtggcgcatagcggacaagaagttccttcacaatatcaatcgtataccattgagcggagcacgaattggcttccataacaccgagacttgccgcagtacacagcacagtgtcgcctgattgggcaatttctccctggagttgatcacgatttgaaattttaagttttcctttctcgtgtttataccctgttcttaaatctacgcaggatgcactagctcgaagggctgttgtttgtgctgtgttccagatgcagccctgaaatcgtgcggccccgccgtgcccatagcgaaagaaataacaaacgggtatcctgcgccgccaggacatggcacacatacacctacgcactcccaggggcttggagaggccatccaaacccgcacccgctgtatttctgcctgtgcagttcggtgcattcatgaccatcttccaggacatcgccacgatcatcaacgagcccccgcgaagatg

SEQ ID NO: 7376 - DNA, 700 bp, Nannochloropsis_gaditana
cgtgagtcctaagaaaatgtagatcataggtatagaaaatgtatctgaggcatattacgcgcatatggcttgcatgaaggccgcttgggtgcctaggtccctccctcagcccctccaaagagcgagtgaaagacggaaagaatttcgagtcatcaacatcgtcctgagggcgcgcgcagttcgtgtggtcaaagaatgccgtgccagctctcttaaagtgtttcatgcttccagagtattggacacaattatttctcacataaaaagaccgacaaatttgtctgatagctgagtttatttttcctgataggctgctcctccaccctcctattgatcccagtggtagatttctcgtaccacttgccgagaagctgcactgaatgtcattatcatcagcgtgagacccctcgaactaagttcatacgtttgcaaatgagcaaaagtcagggaaatgattgtttcggaggaaaaaaagagaacgtctcgagtgcctcgccaacctcatctttgtgaggtctagggttaggcgatggcctcgtctcgagtattccttctttgatgccctatgaacatgcagactgcccttggtttgataatgcttaatccctacaatgccaactgtattatcatgcagggcgcgcgtgaccctcttagattctcactggcatcctttccttctaggcaaccgaaaaaggccatg

SEQ ID NO: 7377 - DNA, 700 bp, Nannochloropsis_gaditana
atgccgctgatgagcgcttttccgaggaaaggaaaagagtgactagcatgaacacgcagtgcgttacccagggcaagccaacaacctgccagagcaggcatcgtgcccgaaggtctggcgtccagcaccacaagacacgtcctcccagcagtccatttggcatgtgccggagtccgaactaacctagagccccgggcgagggtttacatcccacagactgtgatagcttctcgccgcctgcgtcgctctcggccctccgtgggtggtcgagggcgagaagtgaagcaccacgggcgtgtgcatgggggcttggtaccaggtagggatggccacacgtctttagtgttggatggaaggccatgaccctagtgtcagaaatggtggttgttttgggtgcttatttcgtctgccagacttggtaaccaaccattctcagcactgccgcagagaaggagggcgggggcgaaagagggcttattttcttggtgtctaccaggttctttacttgagtaggagtcttgttttggcatactgcatataaatgtgccactgtgcatggaaggataaaggggctgtctcgcgtttggatgcagtgcctcgtacagcctcgagaggcttcgccttacgccgcgacccatgtttctactttttctcgcaatcgcacagcctttatctccgcagcacctggctcgggacgatg

SEQ ID NO: 7378 - DNA, 700 bp, Nannochloropsis_gaditana
gaaaactggggtgggccattaaattcacttgcagcgcatcaaaaatgagctcacacatgaatcttttttatcaaaataacaagaaattctgacaagaatttccgctgatgatgatggtgctctggcgcaaccccactgaacctctcggcctggtggaggaacggtttcaaggaaggttatactcgcgttcacactgaaggccgaagatagtattattcgtgtttcacctagaagatcacgatcctcttcgtcatgcaatgcttataacctgtgtcctctggagtttgtggttctaagtgcagcaaggcattgtgtccggagtggatgctcgccttgttgaacttttttcggcgacgcaagccccgagcagaactctgtgcgcaatgtggcctcgatctggtgccgccctggacgaagggcgatgtatgcaagcgcgagcagctaattcgacacgttacacatatgactcatattctaaaggttccggatgttgtccatcgaccgactgcaaaaatgcttggattttaattttcccgctgcagccgccaatcctgctttccataccaataggggtgtgggtcgcataggcctggctggatttcttctcggagggctttggggagcgcatttggtcctcttctttgctgctttactcggcaatgacaacaagctatggctggtgcggtggagcgcatacatg

SEQ ID NO: 7379 - DNA, 700 bp, Nannochloropsis_gaditana
gtcttcgtcgtgtgagcaggagcgacatgaaaactggggtgggccattaaattcacttgcagcgcatcaaaaatgagctcacacatgaatcttttttatcaaaataacaagaaattctgacaagaatttccgctgatgatgatggtgctctggcgcaaccccactgaacctctcggcctggtggaggaacggtttcaaggaaggttatactcgcgttcacactgaaggccgaagatagtattattcgtgtttcacctagaagatcacgatcctcttcgtcatgcaatgcttataacctgtgtcctctggagtttgtggttctaagtgcagcaaggcattgtgtccggagtggatgctcgccttgttgaacttttttcggcgacgcaagccccgagcagaactctgtgcgcaatgtggcctcgatctggtgccgccctggacgaagggcgatgtatgcaagcgcgagcagctaattcgacacgttacacatatgactcatattctaaaggttccggatgttgtccatcgaccgactgcaaaaatgcttggattttaattttcccgctgcagccgccaatcctgctttccataccaataggggtgtgggtcgcataggcctggctggatttcttctcggagggctttggggagcgcatttggtcctcttctttgctgctttactcggcaatgacaacaagct

SEQ ID NO: 7380 - DNA, 700 bp, Nannochloropsis_gaditana
  misc_feature (1)..(182): n is a, c, g, or t
  misc_feature (665)..(674): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggagaatgggagctcgttttatgacggcgaacggatccgtgtggatgaaaaatcctttcgactggccatgaacgccgatgcaatggccaccgccaagttggcggagggcattcgcggcttcgcggctgatattgagaagctggaggcgatgatcgcgaaaatgctggttccgccctcagaccagttctctcagttggcagttttcaccaccttggtctgcgacacgggcgacgtggaggcgatcaagcgcctcaagccgacggatgctactacgaacccgtctctcatcttcaaagccgcctcgctcccgcagtacaagcctctagtggactccgcgatagccgccgggaaagcagtggcggatgcaggaatgagcctgaaagaaaggctggatctaatattggacaggctggccgtaaattttggggcagagatcaccaaaatcgtgcccgggtatgtaagcacagaggtagacgcccgnnnnnnnnnngtccacaaaccacaagtcaaataatg

SEQ ID NO: 7381 - DNA, 700 bp, Nannochloropsis_gaditana
atcttcaaacaacttgctgtgagaaattatgttgaatatcaaaactatcatcaaatgtagctttcatccgcatcaacgtacttttggagaccccgatgcacgccttggacggtggaggcccgataggcatcttgtagctcgtcctcgatcacggaaggctccgtgcgcttatttcctacacggtataatggaaagttaaatttcgtctcaagcagtcttacacaacaagctgatttgataatgcatcacgtgtcaactctcgcttctcgttgcctccctccccgtaccttcaacgaagacgcgtccgatgcgtaagggcgtgtccgctcgcaccattattactgtccaatccagtccacggaagctcctgctccagctcctatcacatgttgaaagcaaggagaaacattaataaaggtcgagtcgtctcgtgtggtgcggatagtagctgaaaaggcagcaaggaagccccaacgccaacctccccaccagtagcgtgttgccagttggtcagcctttttaggaccttgatgctaaaatatgaaaagctgaagacgcatgtcattttccgtaagaaaatgatctccttcagagatgttgcttaaaaaaatcatcaatctctttcccaatagagaaacagccaaactacacaagggcgaccagagcgatcatctccaattgcgctctccctcgagggatg

SEQ ID NO: 7382 - DNA, 700 bp, Nannochloropsis_gaditana
ggtctttattcttttttggttgaggcatttttacgtattttagcaagtgtaacagtacacagctatctatcccacttctgccgcattcaccttcgctgcaccaagtggttgtaaaaattggataaagcggtatcataatcgggcatggggaaaaaggtttgaaaatcggttgccgcggtccgagaaacgccgaagtactacgtagtacgtggtcgtcttccgctccccggccaagcattaattgacaacgagggaacacgaagcacctctatggtgcattatttgtttaatgagcaatttatacgtatcgtggtctgaaaatgacttcttgaagaccagggcggtcttcttggtggaaagtaaacgcctcggacgaccatgtgactcctggatggagacgacgagcatagtcggctgttaaactcgtcgcactatttcaagtatatgcaataacctggtgggcgcgacctttcttgtcaagatataactatgaatacgagattgtaatttaagtacccgtaggagacaatcttactcagatacgttaccgctctcatcaccacagatatggccttcaaacgatctgcacagaaaatagtccagtggggaaccattataggtagtgcaagtatcattacttggtatatgtggagagatgaagaaaagaaatcaggtagcggcataagcaaagcaacacatg

SEQ ID NO: 7383 - DNA, 700 bp, Nannochloropsis_gaditana
agaaacacttgccaaggggctgggacaaggcaggaacctcatcaatcaggaaaccggtccaacgtgacgttcatggccaaataaaggagatcttcctgtaaatctgtgcatgtttgtgacattggaatggatcaaacccgcgcacatttatttattgagagtcatgcaagttctccttttttacttgaacgtgcgctgtcgtgacccgttagatgctgctgtgaggtcattagagaccatcccacaattttcaagacgtcaatgaggtccattccacaaagtaaaactgccattcacgcctcttcacaccgccaaggatgtgcttcctcttggagaggacgctccagcttcgggatgatggcgttcagtggaacagaacagtggagacgggcagcagtcaggcactagcgaaagctcaagtcgggtttgggggaaagggcgatcagaaagcgacttcaagctaatcaacattttagcttacgcgacgctttttacactcccggaaactggaagtcgcacgtcgcaccgtcgcggtgcaaggggttgcgaaggcggtattgggccgatatctttggaagataccggctttcctggcattctcaacacctccccgtcctcacgcattttccctcgtgtaccgcgcacgcacacttgcattccccttacagcttcttttgggacattacgcacggtaacgatg

SEQ ID NO: 7384 - DNA, 700 bp, Nannochloropsis_gaditana
gaattgggtcgtctctggtggcggcacaagcaccacaaaagcaccaccgccatcgcgaaattgctggaaaccctggtggggattcaaggtattgtggatttttttttccacgtcgtcgacttttttttcgtaggagactgcgtcaacatccctcttgggtatgtcctgatgtataaacccctgtcggccctgcaaacggagcgaaccctcatctacaaaagcgtcaaggagggtctgggtctattgagcgtctggtggcacgctgtaaccgcctatgccatatactgctggattgtccgcaagtacagtgccaatcgcttgaaggtccgccggctcccctatctgatcgtggccgccatggtcgtcaccaccactcgcatggtgctttggcaaaccttgcggaaagatttcctggggttgcggctgggcaacattctctacgatttcttggccgtccccctgcccattttgtgcattttccgctggaatctgggctcggctcgtgccttagcggagtacaacaaacacgccttgcccgtgccagccgcgagcgccagcctggtgcccgcccccgtcgacggtgccgggacaaccttgtcgggccatgcttcggaccaggagcaggcagcaggccccctgcagagcctccggtcgcgttcacacctcccacgaggggcgtttcagccttccatggggcctg

SEQ ID NO: 7385 - DNA, 691 bp, Nannochloropsis_gaditana
gggggaggacgggcttgggagggtctcgggggcgaggcgggaggctgttcaatgagggaagaaaagaagtcttctgagctcccaaacccatttcaccctccatctacaagctcacatagccatcatacgatggatttattaaataaacaaaaataatttccagggggttgacattcagcccatcgttcagcaggggatattttgattatctcgcgccgtacaaggcagcttgatgtcccttttaagccgtaagtcatgaccctgatatcgtttcatgagacaatcaacatcatatcccgcttcgagtacagcgcgagtcgccctaatttcgtattgatgccgggcggtaggtagatctgttgcacaatctagggcaccacgtttaagtaatagttgcaacccaatgcgatctgtggcccacacaggtgcttgcacatgcatcttatcgtcgcagctgatggtacatcgcacaattatgtttatggaatatccgctcttggagatattatcgctggtggcttatacaattcgattaatgcaggagtttgcactcgaaaaactaattagaggagggcatctacatatgtgtgtcctctatttgcgcgggcgcatttgcatcttctgcccaagggaaaacaatctttcacgtttggttctttaaaatctcttgctcaggcatgacgaaaatatg

SEQ ID NO: 7386 - DNA, 700 bp, Nannochloropsis_gaditana
ggcaaggatttcgaaatggagcgtgcgcaacacgcatgtaccacggaagtcggtcaacacatggcaggcgtgctagcgctggagcacacggtcccggctgcgtgtccaattagggcgcagacggtgttctcttttccctgaccacacagtccgccctgcgcatgcgttgaacctgaccaagatcgtgcacatggtgcggctccgcgtcccttccgtccgccttcatgtcacccccatcgttatcacctcacgccgtgcgtgcacggcggtgtcaacatttcgaggcgcggtcgaagtgtgcacagagacaccgacacaggcaaagtccttcacccttttttttttttcgttttccgcgattgctgttcgtccgttgggattgtcctgaccctctgaagggaatggaaagggggcgcccaagcccctgcaatcacgaggatgcgtgtgctgccacttgtttcatttgcttgctttcaccttttgaaaggggaaggcgccactggagacccttcgttgttgattgtcagacggagagttgcacaagcctcctggaagccgtcctttgacatctcgttcgtgagtgcgccctactaaacacccttctcctcttcctgtgttcacatccagagttactgaggcccaggtagtatcctatcatcctctttctttcagtctttcctgagcttccgcctccatcatg

SEQ ID NO: 7387 - DNA, 700 bp, Nannochloropsis_gaditana
tgtacgagaatggcttacggcggcgtccgcctgcttccgacggggttgggctgagcttgtggagctgacattgagggaagggatgaagaatgtcaaaccctgttgtctcccgcattaaaaatgccactcctaccacccccatcacgactctgtttctgcggcgactctccatgcgcgatgaattgagtaagtaattattcctcttgcctcatgcctaaaatggaaatcaggagagagtcagagcaatattttccttttacgaaaagtgacgcacgcagagacgcaatcccggcagacaaagtttaaatctcatgtgtcacatacaatgtgcatactccacacatacccgatgtttcgttagtacaggcgcggagcgtggcagtgaagtctgcgagtgaagcggagcactgttgccgattcggatgccacgccttcaagggtcgggtcgacgactgagacacgcttgcggtggaaatattgaacacgagccacaaaatcctgttaacttgctgtatgagtgcattcaatcagctgagagtatcacatggcccgctctgaagacattgcgttgcgtcggagcagtggaaattgtgaagtaccgtctcctctcgcttcttccatcctgaaggcgagtgatatgccgggccgtcacctcacgtgcagatttttaacccccacagacatcctagattcaaggatg

SEQ ID NO: 7388 - DNA, 700 bp, Nannochloropsis_gaditana
gaaagacacaaagattagaaaaggagacgacgatgtctgcaattcttactcgtggtgctcttttacacaaagatgcctgtttgtacgtgatgttttcgagtcagggacagggagtttgtcagcccgaaccccacagaaagccttctagaacggtggctggcatggcgccgccctctgtggccaacaagcaaagcacagttccctcagccacaagagtaaaaacgcgacgatgagtgcaaaatcgaaaaataaaaaaggcataaaaatgcggttgtgcagggcatagagatcagaagaatttcaggcgccgtacgtacggcgtcttggaggcttcgctgcctgtgagaacgtgatgacgcgcccctgagcccggaggtcgtccgcggggccgcaagacgtgttagacgcaagaatgccgcaaaaactggcgcgcacacgcacatccgaacaatttttgagctgatgcgttgcatgaaaggatgtcaggtgcgcggctgactgcggtcattgccgtgaagtggatggcacaggggcccaccccggacgcccctccatcgcccgctttcctcgcatcgctcacgagacttgcgactttccagtcctacctcccacctttctcgatttcaacattctctgtactactcatcaacagggatgttatcctcctcacagatcagctcgccattttcaacggtgtctg

SEQ ID NO: 7389 - DNA, 700 bp, Nannochloropsis_gaditana
tttactcacaaaaaacatttacacccgataaaaaaggctactggccgactttcccgacttcgattattttttagctttgtgctgtgagtgaatctggagaaaaaaggaagatgaggctgtgcttagacctcgcgcgaagaacaaaaggggtagaccagctatatgcgctaaaacttccacaattcgggcgagcactgcagtacaaacctgttaactttgaaagacacaaagattagaaaaggagacgacgatgtctgcaattcttactcgtggtgctcttttacacaaagatgcctgtttgtacgtgatgttttcgagtcagggacagggagtttgtcagcccgaaccccacagaaagccttctagaacggtggctggcatggcgccgccctctgtggccaacaagcaaagcacagttccctcagccacaagagtaaaaacgcgacgatgagtgcaaaatcgaaaaataaaaaaggcataaaaatgcggttgtgcagggcatagagatcagaagaatttcaggcgccgtacgtacggcgtcttggaggcttcgctgcctgtgagaacgtgatgacgcgcccctgagcccggaggtcgtccgcggggccgcaagacgtgttagacgcaagaatgccgcaaaaactggcgcgcacacgcacatccgaacaatttttgagctgatgcgttgcatgaaaggatg

SEQ ID NO: 7390 - DNA, 700 bp, Nannochloropsis_gaditana
gttgtactccaaaacatgcatggttttcctgactatcttcttctatgcctgatgcacttctcatccttgctcgcatttcttcaatattgacgttgccagactgggcctatgaccaatgggctatccgtcgcctccaaatcactggccgaccggacttagaggtgatattgaagcagcgtcaagaggagctcaagaaaaaagacttttcgtgtgatgacgaaggggaatgcgaaattgattgggataagctgtagagtgtgtagggcaaccattgacagtgagggatgggtggcaatgagaatctgttcaacgaaggtgtaggaagaattttggcggggaggttggtctgcctccaactatgttgtcgactataaaagcaaatggagaagttttggtttgctgttgtggtatatggtcactctcatcattagcgcccatgtccatactatcattttcgtgtgtcacgtgtgtcacgactgattttaccactttttccttcctgtttgatgtcattttgtcaaattgaacaccgcctttcgccgccgtccgacttacatcgcacgccccaccgctcataccacatacacacacatctctgtaccatttcaaacacataaacgcacaacacgcacgtgcagcactacgactgcgatatctgcgaggacgagggactatgttgcgaccctgggggttatgtcga

SEQ ID NO: 7391 - DNA, 700 bp, Nannochloropsis_gaditana
atttgccctcgttctattggtggtgtccggcattcagcaactctccctggggaatgtgtttgatgacgaagagaagtctgcctcgtcgagtggggccgtggcccgtcgaatgaacatgcggaatagaagtttcttcaagaagaagtaaacgaaagccaggggaaagtgtgagggcagttgcaacgcttcatgtgtacatatgaaatagcgatgccagctttaacaatgcagggtccagtcaataaagaggagcaagaaatttgaacttttgatgcaacaggataacgaaaccatatgacagcacgaaatagaatcgctatgcccaaaactttatacttatttctttcaccgatatgttgatttgctgtagtcttcgaatggaaagtgctgcgaagcgtttttttgagcggctcgaattgattggaccgcacccttaaccagtctcaaggaggcttgtgtgtcgtcgctgagtgtgcgcgtgagaccccccgattgcattcacgtccacgtttcacgcaagcgacaccttcaagggacgatgtgccgaatgttttggagcgtagggaggcgtcggcaaattttggctgtgggcttgcaaagtggaatgcaggtttgagtcgtctttgcctgccccggcgctcctttctcacaataattctcgaaccgcaaagcaatcaaccataggatagtggccgaaatg

SEQ ID NO: 7392 - DNA, 700 bp, Nannochloropsis_gaditana
ttcttctcttccttcttttttttctccagctccattgccttaagttgtgcttccaattccttcaattcattgctctttgctgcttgtttggaatttactacctttttgggctttatcttcacggaagctgccatggcgttttcctgctcttccaacgccttcagctctgctttcttggcatctcttgcttgtgctttcctttcttcctcttccttccgttttgctgtcctaagatctgcaccatcgcaccaagctgccgcttcttgagcctcgagtgctgctgctttcagactcgccttcacgctctcattagcggccttcttttccatggccgccgcctttttcgcgtgaacacccttgggtggcatggtggccctatgaatttgatgaggtcgcgtaaaagagatccttagaaacgtgccttcatgtacaaagcggtgataaaaccacaattattgcggtaaaatggatatgtgacgacgtgagtcccaggcgagcctttcttcgtcagtttccaccccgcacggtcccgtaagatatcactgtctgggaaacttttctggttggcgacaaggctacttgtactttgcacactcacgcaaaacttttcctttactgcaggttagaggattgcgttacatttcgggtgtgcctgccgtgattcgcagtcgtaatttccctccgcctcgccgtcttcatg

SEQ ID NO: 7393 - DNA, 700 bp, Nannochloropsis_gaditana
catattgcggcagagaagacaagcacctagcttcacactcagatgcttctctgcactgcaacgatgatcaagccgtgcgggcaaggggggctttcaggtcaactacgtcgaagcagcttttaaaagcggttatgcaggcggactcgaatacgatctttcctcgtattagaagaacgtaccagttatgcccgtcacgagcgtccgtgacaagcgccagaactgatacaatgccgccaccgagcgtggtgctctgtgagtatcgaggaaagggcaggctgttagaatgaccatggaacaatccatgatcttgagtccgcctaggggcgatggccttctccctcctccaggaggtgacgctgaaaaggcaattagacgaacgcatgcactgctaaatgagcgcgtaaagacgtgcgctatggtcaagacagaatttatgcgcacaaccgtgggaaagcagggttccaatgggtcgttgggcggggaagtatacggatgggagctagcgggttgtctttctctcgcaggtagccagctctagtatcatgcacgtcgagtgccgcgagaaaagtgcggtcgagccagagcgctttatagtattactcaagcttattactcaagatggtttcacgtgcctattctttaccctagatcaagagcgtttggcatccatccacgtgctttgatcaactggccggtgatg

SEQ ID NO: 7394 - DNA, 700 bp, Nannochloropsis_gaditana; identical to SEQ ID NO: 5478

SEQ ID NO: 7395 - DNA, 700 bp, Nannochloropsis_gaditana; identical to SEQ ID NO: 5481

SEQ ID NO: 7396 - DNA, 115 bp, Nannochloropsis_gaditana
aaccctgtttcagccaaagacacgcatggctctctgtccatcattcgattccattctaccttaaaatatgcctgagagtttatacgcatctctcacaggatacataccggtcatg

SEQ ID NO: 7397 - DNA, 700 bp, Nannochloropsis_gaditana
  misc_feature (1)..(694): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccc

SEQ ID NO: 7398 - DNA, 700 bp, Nannochloropsis_gaditana
cagcggcgagacgaacagaaagcgcgggtgctccgcctgctggccttctctcctcgctgtcgaatgccggcgcatgcaccacagaaagccaagggcttgtgcccggaggaattataaatgctttcgtacaagataaagtgctaacaaaagcaaccagcgcgaccgtcccaagaaggccggcacgattttcagggcgagccattgtctttgtaacaagaacaagaccgttctccctcaactcacgccctccctctcgtccttgcagaaatgtgcccagagcgtctgcgaacggtgcacggggttctcgcacactgcccaaccctttcttcctcgctccctgtgtaatgtggaaaccgtgccggacgccatccggtgtcaggggacgaagcggaggttttgcatgcacgttggggcgcaaccgattcctaagcgaggcgctagcgaggtcagcgaggacgcataacctgtccattgtatgcccaccgtccgcacttgttgaccctctcgctcacgcacacatccatcatcacatcgtggaatgacagtcaaggggggcttggagtcattgcgtgccaacttgccgagccgaagggatcattcaccatcaggcacgaacattcgtggcggcaaaaatatcccagatccggcctaggatggattttgctctggttcaagaatgggagcgggaggagtcgcagcg

SEQ ID NO: 7399 - DNA, 700 bp, Nannochloropsis_gaditana
aaaaattgtcagaccagtacgagtgcgataggactttagacaccatcgaatgtaatggctactgtcgcgtggctttgcagttccccgatgaaatgctaaaagacgcgccgcgtgtgtgtcaatttctcatggcccaaagtaaaatacgtcaaaagcgggaaaaggagagacaacacgatgtctcagagcacactgagcctctattttttgtaattggtgacacttcatacggtagttgttgcgtggatgaggttgcggctcaacatttagatgcggatctagtggtacactacggccatgcctgcctgtcgcccacctctcggctacccgtcctctacgtgttcggccggaagcccctcacgcagactctccaggccatagctacctgtctttctacaacgctcttggcgcggagcaaagaaaaacgagcgtttttgttttatgagctggcatacgaggccatcattcctgatgtggcactcgagatgaacaaacagctggtaggctctcacgtagacgtaaccgcagcacgccttccgttggcttccgtaagccccatcatgcccttctctgaggaaggacagtacttggcgagtcaagccacggggtgcgagaaggaagcggggaaggtaatctttgcggggggactcgagctcagggtcgagaacaatggagaagagggggagggggaaggagggga

SEQ ID NO: 7400 - DNA, 700 bp, Nannochloropsis_gaditana
gcgcctctttttacggtctcttagcggcttgctgccaaagtctacggtctgaggcaagccatgacagtcttccctgtcatctgcgccctttcgcatggccaccgccaccgatggagtgcgatgtgggaatagcaggcacgaggggcgagagagggcgcccagagagcgggagtaccggattggtggaggagatggacttaaaggcgacccccaagcagctagccgctgccgtaatggaccaccgttcgctcttgttctactagccgtgatcaatgctgtgaaattacgggaaagcagcagcagcggcaggagggacaaggcggggttacgagagtggggcggtcggggccgagcacgccgcatgtcacaggctcatacgcggagccagcaatgcagcaaagtaaatctatagcacaacttgcaagaccctgtctttatttatcgtgtgcaaaatttaatatatcaatgattccagtcgcaacaataaatgtgatgtacggcagccattaaaccaggcagcgagcgcggagcgaggagcgcaaaggttacctcagtgctcgctggggtatagaagttcatgactttgaactaggccaatataatggactctaatacatttcttccttgtatacaactacaccagactcctgtttcttctttcaaacaaccttccaggttttacgaaagctacaagcaccga

SEQ ID NO: 7401 - DNA, 700 bp, Nannochloropsis_gaditana
agatccttgggtgagacggtttcggtagcctttgtgtattcagaggtccacggaaatggactggcagaatcctcggcaggaggttgtccgtcgagcggccccccgcaagagaaaccacgggaatgaggaatcgcctttcccaggacatcaacgtttgtaattttgacccttttcgtaggcggtgaacgtcctttcctggcggtagtcttgactgatgaaggaacttcccgtatcccatcccgatcgccgtcacctagcttgctgccaccgggcttcttgcggactggcatacctgcgaatcttcctcagacccctggagcatggtaagctgtgagtatttgcgtgctacatgaaaggtgacccggtggaacgtgctaggctgccctaattcctacctcagccgttgcaagtaccgccctcgccaaatttagacttccgatctgcgcatcgtctcgagtcctgtggagaggaggacttctgatgacacgtcttggtgcaatttggccccagcgtgtgtgcgctggcatacgggagagcgaaaaaatgatatgcaccacatcccggataacaagctcggatactcaagtaggtgtcgtggcaaacgcgttatcttagcgcccaccgtacgtggatcggagtgccccaatcatgacacaaaaataatatcgaactgatttaaaaaaatagtctgactcgctat

SEQ ID NO: 7402 - DNA, 278 bp, Nannochloropsis_gaditana
ggggggggggacctcacttcggaaaaattatcgctctcgccaagtggaatatcacgaaacatactgacactatatatgcccccgcctccccccttcataccatgctcgtgcacagcgtaaatattcctacgtactagacttggacgccattggccaacgaggaaatcataccgcaaccacggtcctccgcgccgggcgttcatcttcgactttcccggattagttcgatctttttactcagcaccattttgtcccgcccaatttctattcctgccttc

SEQ ID NO: 7403 - DNA, 700 bp, Nannochloropsis_gaditana
atgtgggccgcaacttgacgtgccagaataagttgattgtcgggcagtgatgctgacaagccgatgcaggcgaccgagttgcttgggaagacctgccgcaccaatgcagcaactaggctggaatcgacccccccggaataagcaatgaggttggttcctgtggaagtgccttctagtctcaccctgtcgagggcgcacgcaagcaaagtgcttgtttcctcctggttggtggaggaggttgaaaaggaacttgctcccaccttccgacgacgagcagaatggaatgctgcagttctccaagaatgttgcatactcactgtttgtgcagtaggattaatttttgtgatgtgtttgtgaaaaaggagggaagcattttgtccgatgttgttgttcgtcaccgtaacgttgacggtgagcatcgatccgcatgatctcggtcctaaccacctgcggtcggaaaataagccagcattcaaaacacacgcacgcacagggtcactttacagaacttgttttgtggtggtgcagcagcacgccctttccttaagcttcaagcactactacttccagccaccgccttcatttcgttcaggtaaacctcccctccctctaccgaggaaagacaatagaaattcagatgcgctcgttgccgattacctccttcatggcctttacaatggtcgcaaatgcatttactatg

SEQ ID NO: 7404 - DNA, 700 bp, Nannochloropsis_gaditana
aaatgcgatagcccaacccgtcacaatctgccgcacagggacggtgaccacaattcagctcaaataaaaagagcaacttctagtcagtgccttgcttgcttcaagccagaaggcgcgagaaggactagggcggccttcctttctaattatgatggatcatttcataattgaacaatgcaaaccgtttttaaagtgcagattatgtacagaaatgacgtgatacgtggattccagtcatttttcgggactgcccggttgcatagctgccaagtgccatccgacattgagcttcgtccatacactcagtataagctttcgggggatgagaacgccaaatcggttcatcggagctcaaggacattctcgaatcaaagtttaagccctttgctgtatgagcacagtatctgaaaatggtgacgaagggacatgtgtgcgttggatggcagacaatgatgtaatcatcgtgaactttgaggcaatcttagcaccgatggcaaaaaaaacgatgggaaaatacctattctcatgttatttatcaaaacaatgcttttctttatgtggaagattacatacctgcacaaatgctttactttcgtacaatgcaatggtggagcctgcacagcttgctccgtccgtttgtcctttcgatgtccctcatgctttatatcactccaaaaaacgtccggcttaatacacgatg

SEQ ID NO: 7405 - DNA, 700 bp, Nannochloropsis_gaditana
ggtggtaaagaaactgccaaagaagcgatggagggcccttggagcagagcatcggagccgtcgatggacgtggagtgaccgtggggatggaggaaagggaaggatgccttgagtttggctttcttcatggatgtatgagaaaccacaatagtgaagggccgggagagaatggtggatggagagaaagatgtacagggtttccacgacgtgaaagcagcattcttagaatagcaattcaaaatccttttcaggaatactgatacggatggcggaggtatgctagagctatgcagtatgttatggacgcatattctcgggagagcttagattcacgtcgctgatttgaatagagcactcaagatactggtttagtgagagaggtagaggaaactgaggccttttatggaaggaatgggacttatttttggtccttttattctcccgatgatatgtcaccaataaccacttagtttattaaaaaaattggaagtctcattcattcagattcatatgaatggggcagaagccacatgaggatcaaccaatgtgcctttgcatactcccgtcacgcgtagatggggacgggtggcttggaagaacacatgagaggagagaacgaatggcgcgagatggccatagacgctgtctcgcagcgtagtgtaaatcgagaggtgcagtttataagtgtcctgaaaacaag

SEQ ID NO: 7406 - DNA, 700 bp, Nannochloropsis_gaditana
ttgatgtgtcatgtggcttattagcttcagaggggtacgcatgcgtcttagacccagagggttgtgagccctgatttgatgtgcaagaggccacttgcttgcatacattacgatgtttgcgcccacagggacatggctatgagtttttatcacctttgaaggatgaatacatgcgattgccctgttctctccttctaaaaaggaaaatgatctttacgaccatgtcttccggaagcgccacgcggaagcaaatggtgcttgcctttgttaacttcataaagacacattatcctgccatttgatactccgactcatgtatagaattttgcatgcaatacatgacggatttttatgaaaatgatgtgcttgcgcttcttacttccgccacattttgttttggtgtatttagagcaagcgatacccatgtgcgttcatcctctgttatgaaaccttttggcatgcacacaccacagtcgacgcgtatttttggaaattatatgtcctcctgatattttacacaaaagtggaatagatttgcgcaccgttcgtgcctggtatatatcgcgttttcatacttttttcctcgtgacaggcatactggagggcctggaagcggagccgcggccacagcgtgaatataccgaactagaaaaggacatttatacaaggcatgagccagatttgacataagacacccatg

SEQ ID NO: 7407 - DNA, 700 bp, Nannochloropsis_gaditana
cccgtcctcgtgtggttcctccaagcccatcatgactgccagccgggaaagcagctcaggacgcttttggaggtcctggcggtaggtctcaacttgaaaggagtacaagtggtcgattaaccagacgtcgcactgcggctccagcccgttggcagcactacataccactgcacgtctttgagactcatcctccacgaccccaaaggtgtctcccgcatcaaaagtctcccccacaagctttgactccaggcgggagtacagtgttggtggaaagcctaccgattcaagctgcttacggtgacggtcaagaaaagatgatggaggaggcgaactggttgcggaggcatccatccctgtgaaagctaagggaaaagcttttttgcaacaccgatagtttaagaagccagaagtatcaagctatatcaataatgtatgtgcttgcgcatgaatagcacgtatacgctcgttagatatcaatagcaagggcggcttgtaggttatacggggaggttgcctactatcgttagctttccaaaaactcaaacattttcgagttttacggtccaaatccattttggacccttaccatatcaacgacaattttacaggtcttagtccaacacggtgtgagtacctcgagctgcgcgtcgcgcttgacgttgaacctgaaacgcttacgccaaacctgtgtccttgtctc

SEQ ID NO: 7408 - DNA, 700 bp, Nannochloropsis_gaditana
  misc_feature (1)..(533): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggtataaaggtgggccatggcagatttttttctttatttgcatcgcatcgcaatcatctctagtatcgtctttatcatgaccggcttggacctacttcggagccgaggtctcaatttcctagttgtcatttgacattcatctcgcagcacatctcaccgaac

SEQ ID NO: 7409 - DNA, 700 bp, Nannochloropsis_gaditana
aggaccgggtgtatctgtctgtttgtcgtcaagatttgatgtgcttgacgtggacggcatagaccaactctgtccacactgactatgaggtaacgtggggaattatctcccggggtcaaagctggaaacggggaggttgagcttactgaccatgtgcaaagacaaaaggggcaccacgcatacacattgtttgccacgatcccctcccgaagtcgattaatacaaataaatacggatcacgtaatttttacacacttctgtcgcgctcgaacaagttccaagcgctctttagaagacagatctcttggtactcgccaacggcgtagctcctgccgcttaatttttttaggattatcatgtcctcccaggcgccacaaaaatcgtgtgtgcgtgtgactagcaggcgtaacgaaatgtggtttgacatattcgtgtttatgctacgatcacctcctcactataaccctttcctcccttgtttaactcaatttattccagcaggaacgtcagagtctgaagagcaggcgcaaaaacggctcatacgcttgccacttccgcaacatacccttgaaacacttgtatgcgcctttgtttcctctccttttcttccatcttccgtgttcgatcactgcgcaacgggaagctagcatcggttttggtgataggaggcttgagtagcgtatcttccgggactggaatg

SEQ ID NO: 7410 - DNA, 700 bp, Nannochloropsis_gaditana; identical to SEQ ID NO: 5819

SEQ ID NO: 7411 - DNA, 700 bp, Nannochloropsis_gaditana
aggagatatcatgaaggataatcactcgtcacaaatcatggaagcgggttcctagaagagatgaggtaatttgggaaactctcctacctcgcgtctcctcagattggcttcttcctctgataattttgtcagaattcgcaagatctcgctctcaagttggagaagtaataaagccttcgagaagaaagggcgtatactcgcatataaatatgaggacaagaaaaaaacacgggggaatgcttgatctacctgatgctgcaagtctctgtgcatttctttcttttgagcgatcgacatttcgtcaacagcgtcttcgaaagtcgtcctatacctgatttgtgtagaattgattttttgggttgctaaacgacttaaaacatagccaaaagtgagagaatgtcagtcggcccatgaccatagtagcatggtgcactgttctgcgaatcctacagccttatcacctacctttcccgcagtgactggctcacgtttcccatggcttacgatgcatacgatcgcgcagagctggctttccgtgctggtttgggaataaatttgcttgcctgaatggaagttagtgcaatcagagtcgcgcctcggcgagagcgaaatgatggtcgtcatcgtctgggacacctggacacagcttttgcttcactcacagctggcctcaaccactcgcaataatctcccagggatg

SEQ ID NO: 7412 - DNA, 700 bp, Nannochloropsis_gaditana; identical to SEQ ID NO: 4552

SEQ ID NO: 7413 - DNA, 700 bp, Nannochloropsis_gaditana; identical to SEQ ID NO: 4553

SEQ ID NO: 7414 - DNA, 700 bp, Nannochloropsis_gaditana; identical to SEQ ID NO: 4554

SEQ ID NO: 7415 - DNA, 700 bp, Nannochloropsis_gaditana
gctgcggccgaagcttcaattcggcttgccgaccaagccattcaaagtaggtaggcccagaccgttctgcattaagagcggtacaatggtagtcaccacggatggagaagggagagtggatcatcgggagcgcggcttcccggatggatgagcaggaggagaattgggatacgaaagcggatgcgagggcgggggaagttaaccataaaaatagacccgcgaggtaggtgtactgctgggacagctttccaacatcgcttttatttcttgtgccacttttcaggtgacggccacggaaaacaggcatgtatattaaggctgccaagcgccacacgaggtccgacctcacgctggctttcagcactccggagactcctatataggggatccgtggccgcaaatctgggcggaaaaaccaaaaatccgacacacgtagaacaaaacctgtttcatagtgtgtcgtttagttttcaccaagatgcattgaattttgcgcacaaagaagacgtcaaggcctcgggcagtctgacctcctcagtcgccatcgccctctaccaacgtcgaggtttcccccacaaatcaccttagcgcggtcacccctacttttggggaaaaagcatcttcgcctcacctgtattttacattcgtatggacaaccagatcgagcacagtagatacattgggtgcctgtgaagccatg

SEQ ID NO: 7416 - DNA, 700 bp, Nannochloropsis_gaditana
agacgaaaaaatgggtggcaatcagccgcaagtgcctccttctgtaagtactccgtggttttgaccaagctgctggtatctcgatcttgatcacctcccgacccccgttgtggcttgttgaggaagctgacgctctctgtgttgcgctgaccacacaaaggctgctggaaggaaagtcccggcctcggacccgcacggctctttccattttgcctgtgaatgccctggtcacgggtgagtggacgatggacgtgtgaatgtgcctggatcgccacgcaagacctctcgggggggggtctatgggcgctctccaaaggaactcagcgaggagtttcgtcgtctgtctggacacatatcccacgcccgagaattcccacgctgtctcccaggactgtggatgcctctctgcacctgacagtgttgaaaatgaggctgtctgggaaatcgatttccttggtatgcaccacatgtggccgtttttcctcgggatgatttaacttgatgagggtaagggggtgctcatcgtgcataagcctgtctcacttcgctcatacccctaccttattctacgtcgggcattctggatatcacaggattttccttcacggtactgggacacacctacaaactgggctgatcgccttgcctcgtccgtgggcgtttcctgctttcgagtctctagcatctcctgcgcatcatg

SEQ ID NO: 7417 - DNA, 700 bp, Nannochloropsis_gaditana
ctaacgtcgaaatatttctgtccacggatatttaaaaacataaattcagaatgtgtgagaggactcttgaaatttaggctccgtgatatacctatacaggctcaagcggacgagtcatgataccaaattttcttttcaaaatccacaattttgactacttttcgtaccctctatcatgatccttttacacatgaacgcatggcgaaaagcaataggaagagcaccgtcgcaaatcaccgtgtttccgccgtgcgaccggaccccccgtctgaagaggaaagggaagactgtcgaaagcctgtgcgactggcggcgtcccacccccggccccgccctcctccctttcaagctactgaccacgcggtgccaggaaaaggacgcaggcgccttccccagtggacactagcagacgaaccaacaattctgcgggatgaaaaacaattcgaaaagcggccgcggactggaaaaatctgcccgggccgggttttcctcaggcctcgcccccgacctcgccgtctcgagtgagactcccagtccgagacatgccctcccaggaggagggcggaccgggcacaggcacggtccggtcatggcccggttgcttgacataggtgttccatgcatgactttctggacgacctgctcatgatgcgcgtacctttcctaggacttgccgcgggcgagctcgacagcaagcatg

SEQ ID NO: 7418 - DNA, 700 bp, Nannochloropsis_gaditana
tttgccccccaaacgtcaatgacagtgaggagaaaaaaggaagagagtccccatgctcgtcgacatacctgtgatagagcgcagtcatgaccatgtagccagtggcggggtccgtgtaggtctcctggccctgcgccaccgctgaggcgtgtaagtcctcgatctcaggcggcagcggtggctttactggtggcgccgtagctgacgacgccggggacatgggcaaaattaaatacagcgacctgaacaatgaagaaaatatatgtttcaaagcggctcaaatcgctggataatttcatgtccgaggcgtgtagaatatgacacaggttctccgtgtccgacggcgtgccaccggggaggggagacgagggcgacagctcaagtgcccagagacaaggcctcgtccgctccctccacaagacgtaacaaccgcaaaaaagaattactgacgatgacgacaactaatttttctgcagaagcctattctgtcggggcaattactgctcggcgcacgcagctgatatttttttcgtctcgtttatcagctcccatgtcttcaagaggcctccggggccctctactcctctcccatgcttttttactcctggaccttatcaaagtctgatgcagtcgaagccacagcgagacaaatttttacaaaacagagaaagcagaggagctggcttcctttttgggcatg

SEQ ID NO: 7419 - DNA, 700 bp, Nannochloropsis_gaditana
gtccaccctcattgtcgtcttcggaagaagacatcgtcctcgcctgaggtgcaaaaggggaaaaatgaattttgctgctggcatctactaccaggttcaggagttttgtaaagcgatgcaatagcttctgagcgatcgtcacaaatcccctgaaaccagtacgtgcatcccaatgttgcatgccggatcatatttcaatgcgtcactctgtgccggttgtcaactattcccagcatgcgcatgtaatgaatggtgcggtattgaaacggagtgcaagtgttgtcgctgggagaccggtcttggcgacgagaggtaggcatgtccggcgctgctccaaactatgactcagccctcacactgacttctcacgcccaggaaaaaggcggaaaggaccagcacgaggtggtaaagtgctgctacaaggacctgcggcggcaaattgtttatttttttcatgcccgcggtctcctctcgcgtgcgtggcttttttacccttctggccgcgttccagctactcgggatgcgcgcatttgtctttcgatcccaagtgagcaccaaattggtttcaagatgtacacgtcacagatggataccacaggggagcactgcgcgatttagcactgcttccgccccttcctcgtcgtcaggctcgggctccacgggcgcaaagagtcagcccgagtcccccagacccagcatg

SEQ ID NO: 7420 - DNA, 700 bp, Nannochloropsis_gaditana
gagacgttggaagtggaggtgaggaggtcgaaggggcattcgatgattgcactagccatgatgtccaggaccattttcttcttctcggctctttgccattgtgtcttctcgacgtctgcgtccctgtccgttgatgaggacaaatggtaggctcctctgggccggcaggatcatggaggttgcatatacacgtgccactggtggggctcccacgacaactgctctctcctcgcgtggtcatagtttcttgaacacctagccgggagaaaatctacccagactacgacccggaatctcctttaaaccttcacatgcagttgcttgtgacgtctcgtccttacacctgcagagtttatgagatacatgcatgagactgtcccgggatctttccctcggatcgtgccaattcgcgctctctggatgcgtcctaaactaacgaatatacgcggtagaaccgatctcaatgctcatctgtaggacgactctacgaggctccatccttcttattacccgataagtatcaagttaggctatcgcggtctccgtcagtcgggccgcacgccctcgccccctagtttgttcgtgacgtttcctgttccttcaaagcgatgtcgtagcgagtgctgcaccggcaatcatctaaaattacattattttcatacgctcaatcaatcacaggatctggataagggtgaaaatg

SEQ ID NO: 7421 - DNA, 700 bp, Nannochloropsis_gaditana
atggaaaagagaatttggaagtttttcttcgttcgaatgactgcttagccaacacgtttgtgcaatgcgggagagaatagaaagcagctatgatgcatttggtaaaagcacacaaaaggacaagttgaaggaaagagaacagtacggaacatgagctctgattattcgatgtaatgtaatcatcgcgatacccatggcaacatgaggggaaactttgtatgctacgctgaagagccagcggcgtataatttcacgttatcttctttttttcctatttcgttcgtagaaaaactttttcaaaacatctaggacagcaggtaaagctttcaaagctctcaagtggtgtacataacgaggtacagggttttcagagtcacattcgtggtagatctctaacctccccacttctcaggctggagcgagcgagcacagagcccgcctctggtttatacaaagtcgcctttaaacacccgtacaccgcgtttatatacgctggcatatatgtatgacagtaatgcgtaggatgcaagccttaaaatgcacgtctagaaagccttcctccgcctagtcccgtgcatcgaacaccgcacaaagcgccatcttttccatcacaccgcatgcacagtcctgtctcaggtaacttagattacaatatgcacctaaccacagggcctgctcatgctatagtatcccagaaatg

SEQ ID NO: 7422 - DNA, 508 bp, Nannochloropsis_gaditana
atatatatcagggggggctgtttttaccacctctagggcaatgcgtgtgaggggggaggacgggggcgcccaaaaagtcaaagtatggaaccgaaagactttaacttttctgggtgagtgggtagaattactcatctcccttcatcgttccctatcatcctgattttgcgtacctgtaggcgctcatgcccgaccctttgcattggctgggcgtgaccagaattcataggttcatctccatgtcagatatgaaggtcagccaccggggggaggggtgggggctaaattatgacgatgtttcaattgggcgaaagcagggatgttacgaggacgcccatggctgaaagggaagtacaccacatccccgagcatgcgtagcgtacggcgcgcatgtaccatcctctcgcccccttcctctgcgttctcgctcacggatgaccgtcggacaagcagtcctcagtattgagcgcgtcccggtcctgacctcctacccccttcccacagtatg

SEQ ID NO: 7423 - DNA, 700 bp, Nannochloropsis_gaditana
atttgtggacacataccctgtcacgtctaattgcaggtctgtgcggtccctcgcttcttgtgtgtcatccgtgacggccacggtgtggacaagggcatccccgagcaacaagccctctgcacgccgacctgcccgctgccccactacctgtatgagcgtagccagaagagatccagctatgcgcacttcgcccagggaaattgagcccatgaaatgcgccgcaagtacctggcaatgtgggagagcagatgaggcacagggtaggaggtcatgtcgactgaagagctattgtagtatttgtgggggtgcgcccccctccaggtttactatttgagacctggcgtgttctccagggccgtaatgaaagacataacggtttgcgttgacgacgggtcgtgcgttctgcagagtccgcgtaccgtaagccccggcacgcacacaggcggctgggggctggcttgagcgcggagagaaggcggagaggagtcttcagagaagaagtcaacaggatcgagggcactggaaaggcgggaagtgcaacgcccgcagcccgcccatcgaggcagtatatcttttgagatacaattgagatcctcatggaacccagtattttgttcgtaccctttcaggtgaaaaaccaagagacggacaaaaacgacatcacaccgcagcaccatttctcatcctatatagtaccatg

SEQ ID NO: 7424 - DNA, 700 bp, Nannochloropsis_gaditana; identical to SEQ ID NO: 6153

SEQ ID NO: 7425 - DNA, 700 bp, Nannochloropsis_gaditana; identical to SEQ ID NO: 6154

SEQ ID NO: 7426 - DNA, 700 bp, Nannochloropsis_gaditana; identical to SEQ ID NO: 4487

SEQ ID NO: 7427 - DNA, 700 bp, Nannochloropsis_gaditana
tgagaatgcctgcaagacagcagaagtggattcgaaagcggggatggagggagagaaggaagaaggaataaaagcggcggcgattgtggcgcgagaagttgctcccgatgagcccgcgaaatccgttgagggagaagtgatggaggtaaaggaagagggagaggggaaaagagagagaaagagggaacgtccgaaatggacgacgagaaatgctagctattgttgacgttaatttgtttaccatgttcccttgtaaattatggggcaggaggaggcggagaaaggcttggttggggggcacgggcaaagggtgggtgggaagcggtagcgtaatcgatttcatttctaaaggtgccatattttcttttctatgtgttatgcaggaggatggagacgtggtggagggggcggaggaagggagccatggtgcggcggaggcagccggggagggaggggaggaggagggggagtgggagtgggtggaccaggtcagacggggagggagggcggaaaggagtgagaggggaagataaatgggaggtaatacgaatgagagggaatgagaaggaagcttcgattgagcatctttgtcagatgtcgtgtcaaggctttccctggatcgcttatcggcgcccccttgtcctcccttcttcccttcctcccttttttctcctttcccccctctttgcacacccagatg

SEQ ID NO: 7428 - DNA, 700 bp, Nannochloropsis_gaditana
attcttaaatcctcctcgcttgctcccttccttctctctatttcccctccacccctgctgtgctttcttctcttagatcgggaaggtctacgccgtggcgacggaagacacggacactctcacatttgcaacgtgagtgaagctcgcgtggttttcatttccctatttcctccctttcatacttccttgccttattctctcctcgactgcgatggcgagcgctaccgtgacctgcgtgtctctcagccctcttcctccgtgccccccatcctctccctccctcccctcctccttccttgccaggccacgcctcctccggaacatgaccagcgccggcgacaaccccatcaaagaaatcgactacaagaaggttattttcccaatgtcacttgagaatatcgtgctctgtgtccttctttcctctctttctcttgctctttccttctcatatgttatcgagcgagccgtcatacattgagttgtctgtcatgaaacttggacgggacgggtaagaggtttgtgtcccgcgtcgccacgtgaagccattgaaatggcactcacaatatcgaggtctttggcttcgtccatggttttcgactccaaaatttgagcactcaaaccctccttctccctctattttcagatgttggaggggttggggctcacccatgctcaattcatcgacctctgcatcctgatg

SEQ ID NO: 7429 - DNA, 700 bp, Nannochloropsis_gaditana
cccattacactgttgcgacgcggacaacgggtttcgacacgctcttggcttttttcttgtccggacaatgaaaaagattttgaccgccaaatgaaggcacagacatcctataacaacgaggttagtgaaaatttacatgcagtagcttacactagtcagcatgggcatccaatcgatctatcccgcttttcacaggagtatgacaaataacacacaactccttacggcggtgagaaactatgagaaaacgcgcgagaaagtactacaaagccgaccgtactagtgtacttttagccccacagctctccgtgtcatgcagaactcacggaagcgttccgcgtaaccttgtgaaccatgcctcaaaccacaatacattagcttaaatgcgaaaaaggagtggggagtcgtggcacttatcgctcagatatcccctgcctcgccgagtatagaaagagatgtctaggctttgcaggtcaaccaagaaatatcccttgcgtgccaagtttcgtgccatgtgccccacgcaaaagtctcgattttaaaaaagctcttttcaattggagggacgcaggagtttgtttcctccagcatcgcggaaattactcgaaagttgctcgaagaagaattccgcctgacctctctaccctgctttgctttcacggtacttccacaaagccgaacaggaagaggataaaccatg

SEQ ID NO: 7430 - DNA, 700 bp, Nannochloropsis_gaditana
cggatcgccgagcgcccgctttacacgcgctccgacgcgagagcgaaacggttcgggattcccagacatcgagctgcggaccggtatatctgtggcgggcaaggcccggcttggggcatttgtcattgcgagagctccggcggcgtgacaacgggcccgacgatctgctgattcagacattcgcacaccgcgttcacgtcctgcgggtcatggggcgtcttcaaccccgccatcgcgatgaagaaatcgtggtgatgggacggagtcgagaccagcaccagcgtattggccccatcgccgacgccagagaagctatgcacatcgccgcgcgccacaaaaatgacgtcgccagcttcggcgtatcgcctttcatcaccgatcaggaagtagaagaagcccgacgtgacgaggaagcatttatcttcctgtggcgaaatgtgcgcgggggccccggccgctttctcagccctgatttccatgacggtgaagggcgcatcagccgagccctgcttcaccttggcacgcagcccggaaaagcagacttcggtctgagtggataaacagcggctgggttcggcaacaaggtgagaagcatgagtcatgaagcggtcctcctgtatgaatgaggcggacctacaatctccacattgatttgataagtggacaaaaatggaaactctatccagtttatcggacaatg

SEQ ID NO: 7431 - DNA, 700 bp, Nannochloropsis_gaditana
gttcaacgtgatattaaaggagcgagccttagcgtcagcgcttgaaaaggtagagacagtaagacgacaacattgtgcagtaaatgtgactaatagcaggggttataaatcgcaaaagcgctgtgcaatttaaaggatcaaatccaaatcttgaaacggcatagcagggtcgcgcgggctgcgggccttgaacaaaacgaccaattactgaaacgcctttctcacggctctcgcaagcaacgagccgttgacggacatgattattctcgggcccctggagtgtcatggagattttccgctcattattattaaactttatctcttcgcaagaagacgtagagttttcccaagattacttctgtacagtgtctgacattccttttcaagctacttttcctcgtgaaggcttaatgtcgttaacggcaacagccaaacagccaccaacggctgggagtccgttgcgtcaatcttctctgagaatcattccatgctcttgttattctttgtatccccatctccgttatgataaatgtgtatatagactaacgagcacaatgttaacgactttacgaatctacatgctcccctcttcgggttctgataacttcgaaagtgaaaatacgaagcagatatggtagacagctaaatcgatcaacttcacttggaattgatatcattaaaaatcattacgatcctcacc

SEQ ID NO: 7432 - DNA, 700 bp, Nannochloropsis_gaditana
ccggtcatttgagtcagtccccgtggaggtgtcggggagagggaacgttgaaactcgctcttgtcgctacgcctcgagggggcgaggagattaagacacctacaagtgcgcatttcgtccgcagtggaccggacacgactccaacctggtgcacaagtttgccctcgaatgtctctgtcgtaccaaaatttggcctgtggctgctcgtggcggtctctccgagctcattttggtgacagatagcgccgaagcttgcctattctttcgttcaacatgccgggcatgcgcaacgagcgacctcggcccaactcattttccacccacggcgctcttgctgcaacgttggggcataaccttccttcgctcatgcacaccgtaatggttttgtatactgctggtgctcctgattttcatgattcctcatttgtcctcggaccgtcccatcccataccccgcagggcaaggcagggaggatggatttctgatatagggacagcgtcctgcaagtcccccttaatacacctgcgcacgctcgtatacttgcaaggccgaaaaagcacccgctggtgtctcgtgctgcttttgtcggcggaagcagtggcccgaaccccccgcagtaaaacagtagcgtccgtgctccgtccaggaggaacgtgggagtagttcgacgcgaccagtcgtttgtcatccacgcagtatg

SEQ ID NO: 7433 - DNA, 700 bp, Nannochloropsis_gaditana; identical to SEQ ID NO: 5800

SEQ ID NO: 7434 - DNA, 700 bp, Nannochloropsis_gaditana; identical to SEQ ID NO: 5803

SEQ ID NO: 7435 - DNA, 48 bp, Nannochloropsis_gaditana
gacaatgattaaaaatggcgaggcggcttcaggatcctcaacggcatg

SEQ ID NO: 7436 - DNA, 700 bp, Nannochloropsis_gaditana
gcctctccattcgccgccgcggctgccttcttgtccttctttcccattcctacagttgctatgccgtcatggggatgggagagaacgtcagggtgaatctcacgatgcgacacaaagtgggacatcatgccaagtcggcagcaatcccaagaggagacgctaagtatgcggttctacattgatcagtccatgttttgcggctttgccaaagtatgtgcaggcgtctgaagctggagcaggacgccgagtggtagtatcttcgatcacgccggcagccggcttacttgtctttacagaaaaccctcgccatgagacaccatgcgaaggatcgcgcaagcaacggaagaaaagccagtactggatactatgtgggtagttgcccacagtcactggtttgagcaaagcgcctggaagacctaaatctaccctaaccattgcttcatccgcagctgtttccctcgcttaaccctcgcctttcttccgatcgctgtggcagtgagcacaaacgccaatgtgcccgctgagttttctcgtttcgaatgtctttgaaaggtatgtcttcatctgtgccttacggcagcttaacgagtcttttggtgtcacaacagccctctgcagtctcacgagtcgtttaacctcctacaatcgaactcccggagggccgtgcacaaaccttacctcaccggtagacttcgttatg

SEQ ID NO: 7437 - DNA, 700 bp, Nannochloropsis_gaditana
actatactgctgaatggagagttgtcgatggattgaatcactaacccaagagagtggtttccttcttctcccagcctgaacaggtgctggccttggaggcccggcttcaagacatggttcaaggcaaacttatcaagccgaagagaggggtaattgtacgctctgaaggtggtggcggcgataagaatatggatgcagacgatatcagcgacaggatgagacggaaagtccaaggacgggggggccagggcggttcctcctcgcagcgtggagggggaaaaggaggaaaaagcggtggtggcaaaaaaaagaggcggtaaaatgaaaaatagggctgtcttatgttgtagacaacaacatcatataatttttggctccgatgttacacagctcaggtttgcttttggccagacaccatcctcttgacctccccgcacccttttttgaaaagtgcgtttcaagtcgtaacggctaggtctttacctgtgtaagtcccatgtacccatgcctttgttctccacactctcacaatctcgtgtacaaccatttagcaacacggaaaagtgtctcacagctttctagccaacaatcggaggagcgccggcaggtttgccggtgggcacgaaattctcgtctcctggatgcgcagcagcatttctttttgccagtgagcgaggaacgtgcttgcgaagccatgatg

SEQ ID NO: 7438 - DNA, 700 bp, Nannochloropsis_gaditana
ggtcagccaaggccaaagccattcgaaaccttaaaaacgtaccttatattgtgctaattggtgaacaggggcaataggtttgacaattgtatgctcttgcacatggattcccggacgtggagataccattgcctgcatggcctttcgtgtaggacgggtgggcgagccacgaccgtgcgacgctgtatagataatcaatgaatcaaatgctcaaaatagaagataatgcaactaacaaataatttccatagttctgataatatgcttgaacggaagcgtgcgacaatgatggtgcccggcttgctctggcctaaattaggccttctagctagctccggcggccgcagaagcaacggaaacggcggctcgctcagccgttagatgacgccccaaccccacgccccctggccccgtaaaaataagaggtattagaccacgtactggctgggaacgtgttatacgtggcgcttccgctcgtgaatgatagtatgactcagtcctggcctcgttttgtgggtgttccatcgtcttaccagggatctttgcttcttttcttctcttggatcgcttttgacggtatctggagccaacatcatgttgcagtatcacctcctcctcctacctctcctgatgctgccttgggcaggatggactcaagctgcattcgttactccaagagttggaggcccaagatcttatg

SEQ ID NO: 7439 - DNA, 700 bp, Nannochloropsis_gaditana
agcaatcactcggaatccaaggctctacaattgggatgccctccgcgagataccagaaacaggtagaaaggcacaatgtctgatagcagattatgcaccagccaagcatgtcaccctatccgggacatcttcattgatgaaagtagtgtcctggcatttggaggaggcattccatcgcgacgaagtgatgctgcaccaagccgattttcttagcgcctgtctgatacacgatacctcaacagcaaagagagagcagtcttgctttccccgcgtctcagactggaacaatatgctaaaattgggctacgacatgtctgcccttgcttatcctggctggttctcccccctcctcgacgatcgcctcggtctgggctgcccctctccctccgagtcctccccctctacataccgagatgtccttccgacgcacgtcatcgagcctggtcaacctaatggctgtgtgtccccctctttggtgcaatcgcacggctttccaagtgactgcactgtcgtcggcggcaccaccgacagcgtcgccgctttcatcgcagccggtctccaggaacccggacaggccgtcacgagcctcggttccactttggccatcaaaatgctcagcaacaaggcagtcgaggatgcaactcggggcgtctacagccatcgactcgggaatcagtggttggtggggggtgcgagcaat

SEQ ID NO: 7440 - DNA, 700 bp, Nannochloropsis_gaditana
aggattaggaggaatagtatgaaagaggccaaaagaacgaagtcggcaacccaaaaaaaatacccatcgaacgcacctgcccctagataaagcagcaggagcaaaggcgttgccgaatgccaataaagtcagcactgaaagaacttcgaaacttgtgcggatggtgggtccagggatgacagccttcatggtcgggctgagggcgaagagaaagagtatgagacatgtgaaagtgagcattacatcgagtcggctaccccgtcccagcaactatatgacatctaccggtgcctcgcgggttcactccgacattcatgcggtgcaaggacagaaaggaaggacagcaagcaagcaggaggtcgacgggtttcgacaggggcggaccccgccttacccggcttccctgcatccctttacataggaaaagaaaaacaatgcgctctgaaaggcctctcaattcggacgtttcgacagtcgtgtctattgtacaagaatattcactacttcactgcctggtgaaacttgcacatcctcaccaatgcgttcatccattttcttcccatgtgcccacagggcgcgatgtctttcctgtcgtggtgctggtttttgatcatcatgggctcgttttcttctttgctctgggcatttccatcttcagggagcaaaccccgctgcggtgcaggttttgacttcggtacga

SEQ ID NO: 7441 - DNA, 700 bp, Nannochloropsis_gaditana
  misc_feature (1)..(676): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggaactcttttcagggtct

SEQ ID NO: 7442 - DNA, 700 bp, Nannochloropsis_gaditana; identical to SEQ ID NO: 5443

SEQ ID NO: 7443 - DNA, 700 bp, Nannochloropsis_gaditana; identical to SEQ ID NO: 5445

SEQ ID NO: 7444 - DNA, 700 bp, Nannochloropsis_gaditana
gttcgcgttgggacggtccacggcggtaggttgttgatgcccactctcaagcccgctgttgttggcgtctccttgcggtggccccgcataggtaccggtggtcgacctatcactatacggatatgaagatgctactgctggcataccattgggagggaaaggtgttgcggcccccgaagaggcggtagtagtgccggagagagtgtgaggcagaggtggttggtattgcgtgctactgctcccagggtacccattggatatggccacggggcggtataaatctgaagacggatttactgtccgtctgtttggagacaaactcatgattatgtctgcagagggcaattaatctttggaaatcgaggcgttgataagtaccatggttcttaacatgtaaacgttgtgttgcgttttgaaatccgaacaaaaaacaaatgctggccaagtgcatgatgcacaagcatacaattcatacacactgcacacacacgcaacgcggaaggacgaattctcaaggcccccgtcttagcatgctacacccggggcggtggggtctggcctcgtctcgctcctttcctctcagggaaagatactcttggagcacgggcgcagaaaaagtacccgccagccccgcgctcgtcgtatgcaggcccctcgcttcctttcttggcctacgtgacagcgtgctttgtgacacatg

SEQ ID NO: 7445 - DNA, 700 bp, Nannochloropsis_gaditana; identical to SEQ ID NO: 6278

SEQ ID NO: 7446 - DNA, 700 bp, Nannochloropsis_gaditana; identical to SEQ ID NO: 6279

SEQ ID NO: 7447 - DNA, 700 bp, Nannochloropsis_gaditana
  misc_feature (1)..(22): n is a, c, g, or t
nnnnnnnnnnnnnnnnnnnnnngccctgtgcactgaacatatgatactgcatatttcgcatgacagatgtgaaagaacgatcgacgcagtgtgtgagtgtgtccgaggctccatgtttcacctccctgaggatacgaaggaccgtctccacgcaggcggagtgcctcggactcgtggccgtcattgccacttgtcaggccggaaagagagtgggagggatgggagcctgatgtggaggtggtcctgccgcccaggcgtgggtgaagtgcgtcgtttcccctcagaggtctggctgtcaggaggcaacatagacgtgtgtcgtcaaggagtcatgacggattcaaatgggaacgcagccctggcctcgttcggccaacttgctatttcaaagcatgacatccatcctcacctttttccccctccctgcggtcgtattctctttttccccttcccggtagatcatcgctcaggcgatgtcgtgtgtcgcggttgcggggaggtgcaagcggaacgattggtggacttgggcgccgagtggaatcgatacgatgacaacgacgggaagggcgacccttcccgcgtgggaggggaactggggggtgtcgcctctcggatttggggcggcgcgtccgcctctgcgccgggcgggagagggagccagggcatgggaaagaagcgcaagggacaggggtccgccatg

SEQ ID NO: 7448 - DNA, 6 bp, Nannochloropsis_gaditana
ctgtct

SEQ ID NO: 7449 - DNA, 700 bp, Nannochloropsis_gaditana
aaagaggttaaggacttagatttttttatgtggacgacttatgcctgtgatgattccatcagaattgtcatttcctttaatgattgaaaaacgttattctccttcagtttttgagaaacgtatacctcaaagcctttaaggcgatttttctctgcttcttcgcattaagttcagctagctctgccttttctttcagagcctccatctccccacctgatatgtgggggtctttttgatagcaaggaggcttgcgtctaggctcctgcatatttgttagcgtggaggattgatcttgcggattggtagtatgagaaagcgacaaaaaagtcgacttaaggcggcgattacgagtgactatacgcataggaatgtcttggaggcgaatgttttgtgttaaagttcgcaatgacattgcatatctcgcctggactcccaatttaggtttgttttccatagaccacatccctgtaagtgtatatacacattggcaaaattaccacatgcgtttatcggagtacgatatgaatatagacaaaagagggagcgtttgcgggtttgataaacggcaccgtagccgttagcggccgtttacttccctgaagcattcctgactgtggtctcggtaaaaaacatcccctagcttgaaaatcgacgattatgtataacatttcgttgttgttggttttacaggtccagcatg

SEQ ID NO: 7450 - DNA, 700 bp, Nannochloropsis_gaditana
tcaacatcgtcagcaaagctgaggaatgcggacgccttcatctgtgcagtatcaaagccatttagccatagtaaaaatctgagtagcctacaattccctgctgatatgtgctctaaatggctcatgaggtgcaccaaggtgagttgtgcctcgccagaaaaagcctgccatgatgtacgcaactggtgctttaatggctcacagactccctctttgggctagagggcagcaacgcttgccgacaggtgggctggaggcacaaggggaggaatgtggtaccatcgctgagaggggcttctcaaacgaggctcctccgcgaccgccccttttcccctgacgcatggtgcacttttgtcgtggagagaggcctggcgtctctatcaggcaagtgaatatacgtgtgtatggttgtagatgaagcattgtgccgagtctgccttctggacacagctttttcgcggcacattctcttggcgccgtatcaggatactaccagtactttcttttgaggggcttgctgcagggccttatttaatgcacttctttgaacttgtcaagaccgctcatacatttgtgacacgttccaaatacatcttgtacaaggttatcggtagctcatcagcattcctaggtgctttgccagccgtccgggcggtgggcgaccgcgctagatcaggagagcagtagcagtcgcgcaatg

SEQ ID NO: 7451 - DNA, 700 bp, Nannochloropsis_gaditana
tatgcatcgtagatgacggacgggccactggtgatacttctgtccctttttgtgcggatgagaggctagctgagtggagcaatcgaaaagacgcaacaatgtagttggagatggtttccatccgaacgacaaagtacgcgaaagcgaaggtttccaccccccgaccgcctgctacgccgaggggtgggtgaccgaaggcctgctcaaagcgagtcaagggcgtgagggaggcgagagcggcgacgcggagagggagaagggggcgagactgacgcgcccgcgcggctccttatcaccggcagcggggcagttcaacgccggcacgagaatctcgatgtggtgcagtcgcgtgataatttgcactgcacgatgccggcaccggccagtactttcgcaccacatgtgtggtggggcacgcccgactcgtttctatcttgattcacagcgataggagggactggcatgcgtggcattccgctaaggtctccgtcacgtgcctgccctgcgaaaataaacccacaccggctacatctttttccaagtcgtttaacatatttgaatgtacatcatttcacaggaagggtcggtttgtgggcaacacacgccataattgacacgccgtggtatttcaaacccctagcccttctcggcggggcgccaaacgcagaaagccgattcctcagctactggtataaaaatg

SEQ ID NO: 7452 - DNA, 700 bp, Nannochloropsis_gaditana
tctgctatggaatcccagtacaatcatgggcttcgtcaacttttcgctgaacttgtcataaagtgctgggaggttttcaccgattacctcaggcttgccgctgccggacctaatagtgcggcgatcctgcgcaacgctctccttgttatacctgtgaaggcgtctttgggtacttgctacgaacgtcttgcgcgcttcttggaagtaatagccgaggcgggtgattttagaatgtggtggagtgaaacaacaatgcaagccagtaaagctctggttctgggcaacagagcacgttgcgacgatcaaattacgctcgcttcatcaggatctttggggaacaagcattggtcagcgccagaaggttccatatggttctcagctgaagggcttagatgttttgaaagcatccatcaacccaacatctcctcgtgcgccctggcgtgtatgtttttgccggcctctgcggcggcccaaacgctcagccccgtccagcatgtccttgggcgtatacagtcgcatccctacatatcattgcgatgttgcttggtttcgtttttaatggtgtgtaatctgggcaattttttgcgggagagggatcatcctgccgtacgcgaaaccctccgacaacacgctggagggacgtcagagtatctagctggattgctgcgagaaagtatctcaatatcggaaaaccattatg

SEQ ID NO: 7453 - DNA, 700 bp, Nannochloropsis_gaditana
attgagctcgccctggacagagcatatttttatgtaatgaaagtccccgtccagtaaagttcaggtattccaaataccttgtaccagcagtacagccgaatgatgttgattgtcggggatgccgggttgtaaggtttgcactgatggtcccgccagcggataacatgtctgctcggaaaaaaggttgcaagacgaacacagaatgccaatagacagacgaatcttaaaatagcaagaaatatgttttgtgcatagctgaccgaagtatgcagaaagagcgatgaattgggagggagtgacaggcagagaagggagagggaggaggtaccggccgatcattcaaattttcaaaaattgaaaattccacgacagacgtcatttcccttttcaaaaaggtattaagagcactctgtgtgacgacgtctgaaaaacctttgaatggaatttgggcgttataattaaagttgtagtttctgcaaccttggacttgtaagggtcatggttgcgtttgtttggcgggcttaacctgctacgacactagcaagttgaactcagcatgtcgatgcccgttcgatcttgcgaagcgtacgacgcgacttttgcccttgtacatttcactggaacctctgatgtagtgcagtccctgacttagattcttatctctttttatttctcgcataatctgctccatggaagcatg

SEQ ID NO: 7454 - DNA, 700 bp, Nannochloropsis_gaditana
gcaggccatggtgctttttgagcacgaagaaaaagaagaccagctgctggatttggctgcagaagtggtcaaggccgggcatgcctctgggctaggttcacgcgagcgcttcgggctctttatggcccttacaaagatcaatgccaacgcaaacaagctcggaactactcactacctttcccggcttcattctccaaatctaaacctacaagaagactcccctaatgaaattttactgcatgtcgaggccgtagagatgttgttgcgggcaggatcagagggctcagaaatggcaaagactcctgagtggggggccattgttgcgacatggatagagaaagccgcgctgcccattcttttgtcgcggcgttctgatcttgatattgtctataaaagagtcggtatacatattgcccctacgttagtctctcaaaatgagccccaagcttcgacagcaatggaagcagccacaataaaggtgcttgagaacatatgccttcgagcgaataccccgggagcagagaaggacactagtctcttgggaagggtaggcgctcagattggatgggtcgctgtctttttgaaaggttgcgctcggaatcaagagtatgtcttgcccctcccggtactcgagcgttgtcttaacattatacgatattgtcaaatacccgtaattcgatctattctggtgagagaaatg

SEQ ID NO: 7455 - DNA, 700 bp, Nannochloropsis_gaditana
ggcaaagcttggcttcgagcgcgcaggtttcggtggtgtaccttgacgcctccgttcgaacgcgtacacgaatattgtccagcaaaccccttttcttacactccttcagaacccacaaacgcctattgttgagagaaaagtaagcccctgtggcacgacaaaatatgacagtgatgaagggcaacgcctcaggcttcagtcttccttcgacgatctctgccaaggtatcctccacccttcgcccgcagcctgaaaacgttgtccgtatacgtgcatgggaaaaatagacgatggaaggatcaatctccatgaaaaagggctggggcctgtcacttctgcatccgccgttgccctttccactgccacttttcttgaccatcggagcggagaggctcggaacggcggatagcgataccgcgtacttatggcgcgacaatcctgcatttgaggtcggaaaaaagatcaaagagtattgtatgtgcttagtcgaacatgcttgcaccagagagtgcgtggtagcagtggtcatgctaggcgtgggactgaggacgcggggggggggggtgttggaacgtggtgctcgacgctcgctgaatcgagtctgggaagttgagtcgcggtgggcggttttcacacggccccctgcaagcaaaaccacccttcacaacgcgtcgctcacacgcattcttatgttacacag

SEQ ID NO: 7456 - DNA, 700 bp, Nannochloropsis_gaditana
tgttgtacacgcttgaatgtttgcgcattatcggcccatatgcttgggtcagtatgagcctgctcctggcatggatcccgggatgttctctacggaccagctacacgtcagccgtcccttcgttattgcccgtattcgtgcgtctccacgaggcggagcacacttgacgacgtgattcaccacatgccagtacgggaatgttccgggaatcccgaacatcctttccaagccctccttccgatattttttgctcggagctgcccgacaaatgaagtggccggggccctctcgagaggtcttgggctctcatcgtgatgccgcccttcgagccattctatttccccgaagcagctctagcgccacggtcctcgacactgtgcaatctcttggccgttcttccccccctcggcccacttggcccctcgccagtgcttcaatgcctgagaggcgtggcagccatgtatctgacgaccgagcgagtgggctgcccccccgccctactatccagcccccgcgtgctttatgtctcggcctcgcatgacccgtccaggtgacgagagctgccttttgccttcttttcagaccgttctcatgtaccaatcgtgaggttatcacttttctggcatctcgcaggatatttgacggccggccttcacaaagccgcgcgggaaacaagcttttcgcaagaagctctgccatg

SEQ ID NO: 7457 - DNA, 700 bp, Nannochloropsis_gaditana
gccggaggcggtgcaccaacttgcacatctggcgagatgacagcctcgtcggtcgtcacattctccgcactcgtgccccaagcacctgcgcatacttgctcttctccttccatagtgctatgctctagtaatatcgcgttgtcattcgactggagtgtaagctgcgagtccaggcttgcgctgtacaggaatgcagtggggcgggggggaggttagctttgaaccgtgctgtttgctatggcgcgctccctggaaggctcaagtctatggaatttccgcggtgcttcatgagaagtaggatggcttatgtatgacgcaactgtgaccatttggtcttctgggcgtggaagtggtcatggacacgggatgcctagaggtctcgttggtttagaaggcttcagaaagcgcgcatcgcccgactcgctagaattggccgcgtttctgcgttcgtcctccgcggaactcagtacagtgccggggtagatgatgagctgagccctcaaatacggcaggtatatgcgcgcaatgagaaaataatggctcactgcgccaggaagctagatccagtcacatttttccaagcgtcataccacaacacgtctttctgcattgcaaaagctgcgcctcactccttgacttccactgcttcattcccaacatacacagcaaagtataagaaagtatgacaattggactggtt

SEQ ID NO: 7458 - DNA, 700 bp, Nannochloropsis_gaditana
tctccctggtccggtatgtttacatgctgaactctgacagagccgggtcgcgcacattttggaccgcgtggaaagcataaagaagcacgatcccccacctactccacatgagaagcgccattcgttgacctgcggcagtcaaaactcagcttctacatgccttgacgtgcaggacctgcctcttccgcccacatccgacttgtcttgctttccctccgcaccctccgctacattctccccctcccactgtgtccgagggtcgagctccagcaacggcagtggtcctcctcgtgacgacactacgtcctacttgacacccgctgaggtggaagttctccgccggagctcggtgatcaaggggaggacgttccttccctggatggagggcgaggagtcgcgggagcagttccattacgtaaagcccttcgccgaccccgatggcctcctttccctctcacccaagcaagcggcgcaccttggagggtggaagcgcccgcacgagttcattagagggcgccctggctccgaccaaggtcctcgtatgattgggagcgtcactccccactcaatcatgcaagagcaggtttccgactgctccttcgttgcctctctctgcatatgtgccgccttcgagcaacgtttccaaacccaactcattaccaagataatatacccccaagacgcgcgcggccggcccatg

SEQ ID NO: 7459 - DNA, 700 bp, Nannochloropsis_gaditana
gaccatgaagagatggctacaaaaccgcagttgctatcttgcgaatggcctaagatgatgcagactactaccagtagacagctactgtacccccccggacggtcagggtgctactaggaagccttcaatacaacaatcaaggcaaatgtgacaataaagacatttcttctcaaagtcatgtcaaaaaaagcggctcaatgcctgatgccttcaggtgtaagaggtgtgaggggtgctgtataattactcgcgtgccctaatttgtatgcttggcctgcggtactgcccgactcaagctgatctccacatctctctctccaagccaggtgcaatgaaagcaaataaagaacggactcgaccatcccgacatcaatcactcgtgaagtagggtattatggaggacagtaaagagaccaggacgccctctgaagctgtcatacctccctcgcctttgacagggacggacatcggccttaagatccgttgcccccccaaacaggatcgttgtgctttttttcttaagagaaagttgcgcttttgcacggttccaagacttccaacttcaaagtggtgtggaaatcatcaacatttggaggcaggatatgagaattgtgccgcagcagcacgtagcaagacacaagaaaagcggggtgggcaacgtcgagtgccttgtcccttagactcgaatcacactgtgtat

SEQ ID NO: 7460 - DNA, 700 bp, Nannochloropsis_gaditana
acacgcctcacgaagccacgacgactccatcgatcagcagcgagagcacggcctcagcataccaagccgtgccgtaggcgacagctgtacatcttaccactttgccttttcgtagcatgctgtttatattttaaattaaaaggagagtgcatcacagacttgtgaagtaattttgagcgttggtcaaaatgaaagacgtacatttgccacgacgaacaagtcagtcacatctgatgcgagccgctcttgcctacatatccatttctttttatgacagagaaaagttgacaatgttcgaaattgcggcgggctgtcacaccgaacacacacggacgataaacgaatgacagcatcctcgtcagacgcccgcttgttggcccacctgttggtgtgtggatcccaacgatcgttaaagctacccggaagtattctcgggcgccagcccgacccaatgggcagactgcgcactgcattatcttgctttattacacactacccgcgtggggtagtcagttcctctacccgctggtcaattattctctccaccttcttttggttagtctcaagacgaccacgagtagtcaatggatgctgctcctcgtggtggtcctccactggtgacatacctttctcttgcttgttatatagatgccgccgcaccgagtcacacaacaacttacacaccggacaggccaacatg

SEQ ID NO: 7461 - DNA, 700 bp, Nannochloropsis_gaditana
ttgagtagttctgcccaaactagatcttctaattttcgctctgccgctgcaaatggatcgaccctgtcgtctccatctcttccgtcctgcctttgactcgcagtctccttctcccaaaccatgtttccggctgaccagcttgcacacctttggcggacttcgtagatggctatttttttgcaagcatgcaaggcaacttcacgacaccttttgtcgcctattgagtgcctggtttataaatctgtgtaaggaaggcgtaatagtgtgacagtagccacgcacgtgacacccggacagcgctagagtagtgccgggggggtaaagactcgctcgtgacgttggctccctcggcgagacccgttcctgcttccatttcatcgaggacaagtaagaagtcgacctgatggtctttcgtgatcatggggctttatatctgtgccatagcattctctcgatgcgtgtcaacggagtgctttatagcgtctgttccttgtataaaggggcttcgctgaagcctgactatgatggaacctcacggctgtctcatcatcacctgccagtgcctccccctactctgttgcctttgataaagcactcggcaatgagggaatggctgctgctaccagatgcagcgcttttccttggagttgctggcctttgctttttagaaagagtgcggtcgaaagaagactccgatatg

SEQ ID NO: 7462 - DNA, 700 bp, Nannochloropsis_gaditana
tcgtcagggagatgcgagtctcgagtcagcatcgatactgtcaatagtccacgcccatctgcatttacttctctcccatagcaagcggttaggcggcccaaactctagtgctggtttgaacggagcgggtgccgtagcctcaggaggcattacgccaagtttgcgagcagggacaagtggtgtaccgctcctgtcctctcacgggggtaagtggcgcaaggctctcgcctcaagtatgtctatggatgaagcaggcatggagacagccttaagcaacgcaggtgtggcatctctatccacaggggttcctcccacaccgttggacatatcaaaatctgtccactctctgtccgctatgctgagtcggcctttggacgctggtaatgttaccagccgcatgcacgaagtgtgtgtgaattttgggccggacaaagacgagccgttcgtaatatgcctactcaatgaactcaacggaatcttattggacgaaaagtacgccattggaggtggtgatggtagcagacgcttggcggcccgcatttgtgaagtgttgctgaagcaaagagaaaatgtcatgacagagctctttaacccggaaagtagggataagcagattaagggaagtaaggagaaacgatttccagacatcataagtgaaggattttatctattactgccagcaaaggaagtcacgagtatg

SEQ ID NO: 7463 - DNA, 700 bp, Nannochloropsis_gaditana
ttattttcggacagcttccgaaaatccttcatgggcttcatagaagaggccaacgccagcaaattctgtacacgcgtgcgttcgtccatgagttggaaggcgcgtgagacctccaaaaggcggggggtcaggcccaggctgctctcgtcgatgtcagtggaggacatgtacgtcgtcgtcttggccccttgtgtcctttgcgacgaagttggcacacgcaactgatgtctgtggcccaccaaaaagccctttactagagagatcgagatcaaaaggattagaactgcctgcgcggtgcccattttatcctttactgtagaggatagccgcattttgttccaatcgggccggggggggaaacacacgacctaattacgggtgacgattaaaataaagaatgaagtaagtaaaatgagagcaaagcatgtttcagatttgtacagtcggataaggagatcggggaggatgcggtcgcgagtgcacttttgtcgtggaattgtcgactcgctttatgtgaaggcatggccacagtcacagagagcaagggagctgagatccggcgcttccgaaccaggacgtgagtgcttaagcgtgccaacacgttccaaaggccttggggtccatgatttatgtgcatcattttaattccacacgtgatgcttcttttctttcggaatttggtccgcgcagcgcaatcatg

SEQ ID NO: 7464 - DNA, 700 bp, Nannochloropsis_gaditana
gccatagcaccacaacaacaagcagccatcgcaccacaacattttagcttaccgccggagctgcttgctgcacggtcttaatggtgtcaatgggatgcatagccaggtctccgatagccgtggcaacaccgccctgtgcaaaacgaggagaaaattgtcatctttcgatccctcatttccccgcctccatacgcatcaccaggcacgtaccgcgatcatcatgtcgatggtgttaagtttgtgggtcacgtctgccttgcgtgcagagggcgcaggtacgaccttgaggctcttggcaggcgcagccgggagggcacgcacctggttttccagggcgtaaagcgctaatactatcaggagcaggagcggccggtgcagtcccgtcatggtcatcgtcctcgcaaagcttggggggaaaaagaaaactgcgggagaaaacccggtgtaagcctcaagaaaaagctgtggacttcccgccgcgactgtgtattcgtcggtcgtattcaaagtgatgtgcgggcgtgagagaaaggagaaaaaaaggcctcgggcacgatattcgtgcgagatgatagggagccgtccatcccacggaggctctagcgtctgcccctcccacatacaccaccaccaccgaagcacagcaaatatgtgcctgacatgcaccccgactctatttccctattctacaggaattatg

SEQ ID NO: 7465 - DNA, 700 bp, Nannochloropsis_gaditana; identical to SEQ ID NO: 5036

SEQ ID NO: 7466 - DNA, 700 bp, Nannochloropsis_gaditana
  misc_feature (302)..(333): n is a, c, g, or t
tggtctctgaaactagccattcgtctgtgacctgtaattcaatgtctttggatggatatgcataccgaacacatgcgcttcgtgagtcctaagcgcgtgcatgtttggcccaaaagacgcgaagggatgaatcgctaactcaagtccgctcggttcaaccggacgaacagcaagtactcgaccgcttgttgctttggaggccaaatcgggaaaagaaatgtatcggatggatttttttttttaaatgcagtgaattaggtccgcgttttatttttgaactgttcttgacccgcacaacgtannnnnnnnnnnnnnnnnnnnnnnnnnnnnnnnaagacatgggtattcgccatgaggatgagggcaagcggtccggaatttggggaagccggtggctttggcgaggcggtactacgatgaaggggcggacgagatcaccttcttgaacatcaccagttttagacagggggtcctcgacgacttgccgatgctgcaagtcctggagcgggcctcggagcaggtctttgtccctttgacggtggggggagggatccgggggtacgtggagccgagcaaaggggagggagggaaggagggagggcgggcgtggtcggccttggaggtggcggcccgttattttcgagcgggggcggacaaggtgagcataggaagcgacgcggtcacggcggccgaagagatg

SEQ ID NO: 7467 - DNA, 700 bp, Nannochloropsis_gaditana
gggctgtatccctcttagtgtaccgcctgatcttccctcagtctcagccactcctgccttccctgaatgtaactatgcactcccccggcaatcggtgtcctccgggcgcaactgaaagtctttattggtgagaaacaatggagacaagagtgatggggatgagctcgggaaaagtgctgagatggcgccagagacatgatgcctcggtgattcaaattgacgatgacgacgcgcgctcgagcagtaagagggcttgaggcccgtaatccgcctcatccggcaccaccacgggtgtcatggccatggagacaacatgagagtgagttgtacaccatgctgtgaaggaaaggcggacaggccgcaggtttcggtggtcatgtcgaggatttatttctgttgccccgattgttactcgtggcctcggaaacaacttgacaggcccttcaacccatcgcagggttgctgcggtgggcggctttcgagacgggaatccgcgcgaatgggtgaaattctttaacgtggcacgatcggcacgaatgtcttcatgccaatgtatcctccctggactgccagacagtatcacgaagctttagaaaagcagcaaagacagtcgagtatctcctcctcactttacgacatgcaacacatacatcaggacggcgtcccctcaagaactgcgttgttgtgattaggcaccatg

SEQ ID NO: 7468 - DNA, 700 bp, Nannochloropsis_gaditana
tggcgggacgagctggggagggagtgttgacaatcgtgtccggaacccgcgcctcgatacagtgagttggcaaggcccgatccacgatcgcatcgaacgagacggccgatcctcgtttgcttcctccctccccatccctcccttcttgtcgagctccagttcggcccatttcacgcgcatagggcctcgttgtcagcctcggcgtcctttagagctgatgctggagtcctatggtgtgcgtgttccgccctggatcgcagaggagttgcgtacgcgggaagcgtcggcagttgacgaggaaatttcacagacctcccacagaggaacgagaaaagagaggaatgaccagctttcggcgtgctcttttgttccttctggtgggaggacaaggagcgtggaggaccggcgcggtgatccgccgggcaaatcgattacaacccccgccccacccttctgcccccgcacggacactttggtgcctacagcccctcgtgatgtgtcctcgacagtcggatgctcaccctcgtttcctggagtggacgctgtaggcatcgaagcgctgggcaagagtggtcccgacctgggtgccggtgcactcgtggcgagcgcagcaaagtacggcatcgccctgcctatggaagggatggagaatgatggaagaaaacgagagaggggagagcgggtggaaggactggaaatg

SEQ ID NO: 7469 - DNA, 700 bp, Nannochloropsis_gaditana
tacgcttccccctgagatccttgggggtaaaacgaggacgcagggccagcgtacccaaatccagttgcgtgagtacatgaccccaatcccaatgcagctccttgtaagatggtcaggtccagcacgatcagcgcgaatccaaatttagtgcgcccgcccatgggtggctcctggccggtggtagatcttagtgttgaggatgtgcccatagagcagcttcgatactttgagggttgagaaccctcaaaagccagtcgatacgcgggttcctagtctatatctacgcgtgtttctaatctgtgtctgggcatatgtacagatccgtggtaagttgcatgttagatccagaagaagtccagagtagattctagcggtttcttccgcagtatcatcatagcctctacctttgtgcatccataaataccgccactgacagacacaagcgcctcagaggaaatcaaacatgtgaaaataaatgcagcgtgggatacgcaggctttctgtgctgcccttgttgcccataaaatacattttggcaatacttatgcgagcgtagcagccttgctaagaaaggcaccagcatactgaggaactcgcttttttcatgtcgtcgagacaagcgatttgtgtatttcacagataattggacaaccactaaaaaccatccttccctactttttatactttcgcggacgtaagc

SEQ ID NO: 7470 - DNA, 700 bp, Nannochloropsis_gaditana
catgatcatgggccggacgtgctcccccatgccgccttgcgggaggtgcgagtaggcggtcagggctggattcacgagcactacaggggccccccgcaatgtcgcaatggcagtgagtcgctggaactcggacacctccgccaaactccccgccgcattttgtgggacgaaaaagacgaccatttcaggcttgttcccaatgtcaatgcgctttgttttgggaaagcttttggcgctgccgccgaggggaaaggacggggcccggcgcttcttaccctcaaattcagcgtattcctcgctttcttgtcttggcctcgacaaatactctatctgcagctcatccaacgcacctccttgcctcaagcgtttttctacaaagctggcttcttccctccgcccaaacacagccacgacacggtggtacccatgatttcgtaagttcagcagcaccttctcgtataaaggcaaatagcgatgactgaccgcacaggaccaatcctcggacaagtcatgtatgtcgtccagttgaaggtcgacgcggagtcggggggctgatgtgatgaggctggggcccggtgatatgggagagggacttgcccgtggcagggacattgaggttgagaccgaggccgccgcttccgcttctagctgacgatgccgtgcgtcctcctctatcatccttgccacactggcagcaatg

SEQ ID NO: 7471 - DNA, 700 bp, Nannochloropsis_gaditana
atcaacctgacccgcgaaataagtcacgcacaagcaaggagagacggaaggaggaagaggaggcagggctgggaaagaaaatcgaggatgtgtaaaaaggacaaggaggaagaaacggatcgtaaaggacaagggagaaggaacggatcaatagagagaagaaaagaggccctcgcttcctctttccttcctttcctggctccttgtctcgtttcctacctttcagatccttgaagtcattgctcgacttgacctcccccacctcaactttgtcgcccgtgtcgtccgagtgctggcgactttcagttggaaagaggcatgccagacttgcctttagtgcttaacaatatcaattgctccgagctcatacgggtgattgaccgactgtgtgagataggactgacatgactttggtggtgtagatggccctataacttcaagttcgtgacgatgagaggatcgagacgtgatgttaaagcaacgtcaaggggcggttgaggaagagacgaaatccaatgaaggagaaaaatgaaattctgccgcacacatagtttgtccagcgtcgcctgcctttttacgtgtaaaggtaggatttaggtgccttaagacgacctaatggggagcgattgcctttcaatgcatttcataaggttctctttcccgctccgaaaagacagggtaaatcgctgcgtttctgatg

SEQ ID NO: 7472 - DNA, 700 bp, Nannochloropsis_gaditana
cgtccaagcccccgtcatccaggaactccttcacgccgctcaaatccccgtctgttgattatttcaagaacgaggatgagtcgagggcatgctggagcatgagacagaaagtggggaatcttaccactcgcgcagatccaaatgttgcggtcgagcgtggcggccaccatggctgatgatgaatgtctgtagcgtcactaatgtggaatatatgagacgagcgtaatcagagggaggggaggtcggagggtcttcagcgccctgctttgcccggaatgcatatcggcttgactgcttcctgcatccattgatcctatattgtgaccccctgtgtcatcagtggtcctccacaagaggatacatggcagggttgccacccttgcttggcaaagattcgtccctagttccccgcgtgacctcgctcgtagtatctctcggcctccctccagagtgtgctgcgtcgccgagactggccgtgactagggaggaacaactcttttctcgagatgatgtcccgtatcacgccatcattcaattacttcactcaagaaacacaaatttcccggacgactataagggaagaagtgagaaagagcacagatcaaagcgcggcgaggcatcctgagctgacataaagcatttcggggggcttgaattcacaaggcaacgcgcatagcagcaccaaaaaacgcctgttatg

SEQ ID NO: 7473 - DNA, 700 bp, Nannochloropsis_gaditana
tccttgatgacgctgaagatgccgaagcgcgtggcctgcgcggtggagacctaaaggagcgagcgaggtgagagaagggacggggtggcggttatcagtgttgtctcggtcataatttcgcctcaaaggagagggtcctaccttcaagatggtggggaggaggccgcggtataccccggagagcttctcctccgccacgatggtcctcacaccgtggaagaatccctggtacttattagtgccgcgaaactatgcggtgaagaaagacgagaagggtcaggtaaggctcctattcgggcgtgggcggggcgcgaaggaaagcccttcctgcgacctagacggacctggtcgtgtatcaacttgatcttaatggtctcctgcggtgtggtcacgaagattgcctccatggttcccgcgccaagccccgccaggaatcctttggcttggcccagaccgtacttgtcccctccgttggcgtcagtgagcaggcccgagaagaactcgaaggagctgaaccggattgctgccttgggtgccgcgaagtacagcatggaggaaagcccgcggtagaagccgaaaaagccccgctctgccatcgtctctgatattacttgttttacagacacaggtctggggctcagctgctgcgtcgtcttgacatactctgttgggaacgtactgcccagcgcaacgcagaatg

SEQ ID NO: 7474 - DNA, 700 bp, Nannochloropsis_gaditana
agaaagaacttggctcttgctgcacgagcccatacgcagcgctctattggatttcgaagaactagttgcgtcgccctccttcgatccagtgcagtacccttggaaagtgaccaattttttctacttcttcaacacggccttcgctccctatgtccgtcggcaccatcaggtggagcaaaagatttacattccctgggtggccggtaaaacggagattccggacgaggtcagaggaggatatgatggaatcgaagagttgatacaagaggtggaggccagcgaggccgaatacaagtccttggagagagcgatccgaaaggggaaaatcccaccggcgagcgtggagacaagcgtggttcggtccgacacctcggccccgtctaccttgggtcccttgtcgcaggggcatgaggatataaaggcgaagaacagggagaaggctcctgacgaggagggcgggcctgcgtcggcccctgcctccctgcctgccacgtccctggcatccgctcctgctccatcccccaagaataccccgctatctagcaggtctctctacgactggcgccgtcgcctcatagcacgcctggaccgcctctcccaccatctcatcgtccacatggaccaggaggaatccttctttccccccgccgtcctccgctacttctcccaacacgaggaggagcggatcctcgaacaaatg

SEQ ID NO: 7475 - DNA, 700 bp, Nannochloropsis_gaditana
accactcggtttaaaaataggtgctccgcccctgccaggtcgtgattcaccaataacgagacaagctcgggaggttccttccaaagcacgggcttgaaaggcccgtgtaagattttgaaggccaaaaatgatccaatcaccacaaccacggccatgaggacataaaacggtgttatgaagggcaaatagcccataccctcctcggacacgccttcctcctccccactcaggctattgccctttcctgttctagaaccggcatttcccgcaatttgtgaccgtgttcgtggtggcatcttcctactggtggtacggataagcaaaagaggaggaggtagatatgacgaagttgattcgagagcgggccgtatgaaccgcagtgtgaaatcgtagacttctatttccattctgtaaaagcgccttttacacatcggtacattttgaaacgatgttcacttgtgttaggggtcgaactcgaggaccttatcctggatatagaggatgcgaagtctatcccttcaacctcccctctcgggccgcattcgtcacagtgcccaaataccagaggcgagctgtgtgtgtgagaagaccagtgtacttcgtctgctccattcagcatttctgcataaatcccttagtacaccggtacagctacgaatcgtctctctattcgctcacatgtcattcctttgtcaatatg

SEQ ID NO: 7476 - DNA, 700 bp, Nannochloropsis_gaditana
caaacgacgacgtcgtaagggatggaggatttgcaatcgcatggaacggacaggagcagtttgtctaaatgatggggagctatgtagagctgacattgatggaagccacacacagtcatgagtagatcaaaggtacattttggatatgatgattaaatcaaagacaaaatgctttcgttatttgtgtcatcaagttttctcacggtcgcgttgatgctttagaaatgcttagtcacgaaaacaggaagcggaaaggaacgagggagagggccaaggtctgaggtctgagacgaccgacatggagtgaataatggccatctctcgagccgatgcacggctagtaactcataaaaattattgtacacgtagccctcgccccgcttctccccattagggattaacttctaaaataagccggcgtcgtcgcataaaaaagggattaagtaaaattgaaagagggaagggaggttgctctctcgctcgaagccagtgatgacgatgtcctatcgaacctgactcccgccctactcaccatcaagtattgcggcttcccactctggtgtatgtaggcaaactgtgcaccgtcggattctcacgtgcggtgggcatcgcgttcgaagcatatttgcctgcatttcctcaagcgatgtcaactctcatctatgctctttccctttggcactggaccaagtctaccatg

SEQ ID NO: 7477 - DNA, 700 bp, Nannochloropsis_gaditana
tggctcataaagtggtagtcgaaggcgtcggctttgctgagagcgagggcgggaaggtcagaggctgcgaggagttccttaacgaggctgtcaaacctgaggaatagggaagagaggaggggatgaaagcaaggacggtgtcagaatttcagcgctcaaaacaacgggcgaagatgttagagacatccgcaagccaccgaattcgctggattatagaacaaagtgatcacgacaccatctcggaaagcatcactggtggctgacgtataccttcagcctcctcgatttctatatttagccaacgtacctttcagagtttaaagcttccacatctgaggctgttgctgccgaagagctgaaggagatgtgcattattgggttggcaggtgcggtcatgcggtgtattactttctgcccatggttcggagtccgcgcggggaaaaaaaggaacccagtggagggaatagcgagcagtaccactagcaagtaggactgcaaacacagaggcatctggtgcgtgggtgtatatggcaatttttacgtgaattatatctcgacgtgtatgattataagtacagtagcggtcgctggagttgaagtggactggaatggattgaggacgtgcgagtagccaccactgcctcgctcgcgaggtgattgactgcgagggaataagtaagaccccacaacaaatgcgatg

SEQ ID NO: 7478 - DNA, 700 bp, Nannochloropsis_gaditana
cagcgccgtgcggaacaatgtcgacaatctctcggaagccaggacaagtcccagagtctaaaagaaaggcaggaaggagtaagggagggaaaggagggagaaagggagcgtgtaggactgcgactgagggcccaaggtcctgaggagggaaagctgaagttgaaggcaagggaggggtgacggaaacgctcgcacaagacaagtgccatggacaccaaaaggaagcaccgccaaggaggctaggcccgtgcatagtgcacgagacatttgcatgcttaaatgcaagcgcgaaaaagtgaaggcggagaaaatctctgaactattgcaccaagctccctcccaacttcggccccgcccgaccctctgcagccttgtttactattcctgatgcctcaaaatgatctttttaaactcccttgggccagtaattgcaccgtttaccacattatacagtatttaaatgtgcctgtgtccaattttggcgggggaaaagcgtgtataacgacgcgctaagagggccatggggaattgcgtttactattgtagccgcggtaatcgtgttcctgttagcctgttagcaaacaaatctccacacctgatcatataaacgtacctttacaggccaacgatcaattttttgaaggcatgaaaagcaaaacacggctctggagtggacacgtattgtagtttgttcaccatg

SEQ ID NO: 7479 - DNA, 700 bp, Nannochloropsis_gaditana
aaaaaaatcgccagaggtataacgatgacaccgaatagccagacataaacgagagaggccaataggaggcccccgattagccgctccttgaagcctggctacggtgtaggtgaggtggaaggggcaacggagtcaaacataccagcaaaaggatagagtgttagtcagagacgatgttaatcgccttcttaaagaacgaaagcctcttgcatgaatacatagtggcgaaaaacgtagctgaggctcggggatcatgtcgacaatgggccacgaccctcggggcttgacattagatgcacttaccggaggacgactggagacccgagccctggaaaccatcaacacaagtgtagctttgtacttcgcctgaagaaaggtaaacaaattttcgtggaaacttatcttttgcaaactgccccatgtacctggggagtatttggctggaggaggcgggaggtcggcgagggcccctaatcaaacccttctcacatgtttcacggggacttaagcaatgatcgaacccccatcaaagatcaatcgtccattcaatgataaaaccctgttgtaggactcgtgtgcaccctgcttgcccggatttggggacacactgcgggccttaattattaggaatcgtatccatccaggttggccccagtaacttgactggtccccatacatatcccatttttcaacgacaatg

SEQ ID NO: 7480 - DNA, 700 bp, Nannochloropsis_gaditana
tttgcacaaattgtggcgacgctctcttacttgcgcaaaaggcgctttcccaaatccaggccctttcccccttttccgtcttctctcctcctacctcgctcgagggcctcgctaaagaagtctgaagatgacgccctctcttccagtgtgggcgtgccctcttatttgtgacctttgcatggagtctgcaaaggttggattaccttcccacctaccactttcatcttccttacttctgatgattaataggcattccgcactttcgattttgattctgcgaggccgtaggcattcgtgttcgcattcgaacacggaggggggaaattttggagcgctacgtgacgggacgattccttcacataagaatttttcctcgttaaaaatgaaaccttcgtcgccatatagatttaatattgacggcaatgagatgtatacattttctgtcattcgtgtatgaagatcgtggcaagtggcgaccgctgcacgcttataagtctgcaaaacggtcgggtcaatcgcttccatcacttagctttgccggcgcccgtcgcctacctcgctccttgcacaatgaatgtctcatcagcactcatgtgaagtgacgtctgtgtacaccatgcgcatacctttgtgcccgtcacgtacttgtaaggtcattttgctgccggatgtgtgctcttctcacttcaccccacaaatg

SEQ ID NO: 7481 - DNA, 6 bp, Nannochloropsis_gaditana
tgcatg

SEQ ID NO: 7482 - DNA, 700 bp, Nannochloropsis_gaditana
agcgtcgaacaagactttaccttgctcacctgccttgcgacagagttcatacatgccctcaaattcaccgcgaactgcgaccatctggtcatttgccgtctggatcacgtccatggagcgcttgactccatcgagtttgacctgaaccattccgctaagttgcaattccagggaagagagcttctttttataatcattccggagctctggtaagtcatccagctgtacctgttcacaaaatttctttttaatgatcttgctggccttctcaaacgcctctgcgtctagtttggaaattgtgccagccattttcgttgtgttgcttcgtgtgcttggcggcccctctgctgacgtgcggagggttggcatgacattgctgtttccgcttttcccggttctgcccattccagtcggcgccatggccacactgtcaagagatcttggaatgtgaaggtgtgaaatcagccccaattcatgtggcacaaggaaaaagtcgttctccggatggggccatgcgatgggctcgagacttgaagttttgacggcgaggccgggtctgccctccagcccgccttcagataacgctttgtgcctatctgcatttcaacgcgtgctcgtggagcctcataaatcgacgtacttctctatttcttattactcttgtccctaaccccttcgccgttccaaaaatcgcggtcta

SEQ ID NO: 7483 - DNA, 700 bp, Nannochloropsis_gaditana
catttacttccacagatgcgtcaagctattatgccagctatggcttatattgagaatttcgagtatgttaatgacctcgacgcgctgggaatatgtaatgactgaggaaatattatcaaaatgatacctcaaagccctcatcaggagtttgggcatgatacggtgtcaaaatatataccatcctgactctcacctcgaccgttcgcgccccaagttcctgaacaattttgcgatgctcctcaaaagccccttgcaaagccaagataccgatgcagggcccagatgccactgactctgccattgtcttcgaggactacacctgtggtaatgcgcaaagacggcgcgtcgtgtcaggcgggatggccgagaggttggagggtggcaagcgagggtaccttttccatcacatccgagaccgttgactcctcgccccgccctcgcccaaaccgcccttcgtcgagaagcgggccagtgtgctgggcgccacgcttgccgtgaggcatggtggacactatgtcgaaaaagagatgaaaaaaaatgcactgtcagccttggtggtgtggaaggacagccaaaatatcggcggaggacgtagaatactcagcgctcaacgtcgaccaggtagattcaacgcctaatccgctcgtgaccactgctccacaggtactcaagtgtagggcgcaataggcacttgaccatg

SEQ ID NO: 7484 - DNA, 700 bp, Nannochloropsis_gaditana
aggcgagggacaaagcaagtggttggtcctagatcttcctgaatctctagcgccgacgatttatgactcattgaaggcaaaagatgcatcaatcagtttgtcttgtgtgtggcatcgggagggaaccgaggatgccatgatagcagcagaaggcgaaagctatgcagacttgactaatgctgtgtgcttgggaaaaatgctttccgctgtcgattggtccggcgtattgtactgcgggttactgtcggaggataaaggagagcgatcggagctgtttgcacgtgtgctggccttgactcatggtgcactgcgtatagaagaaaagccccaccctatgaatctgtggctagtaactcaaggggctcaagacgtgggaggtggctgtcgtgagttgaagcacacgtgccaatcgtgggtgtcaggatatgctaaaagcgtgaaattggagcaccctgaggcgggagtggtgcatgtggacttggacgctgacatggcgccgggagcagggatagcacagcaacttgccggcctccttagcggtcaaacgaagttgccgacgacagaagtggaagtttgcgtaagggataaagagattcgtgtgccccgtctcatgcgaagcagcgttccatttcgcggtccttttgaagttgatttaccggagcgtggtgcaatcagcaaccttaaactccaacaggtggct

SEQ ID NO: 7485 - DNA, 700 bp, Nannochloropsis_gaditana; identical to SEQ ID NO: 6038

SEQ ID NO: 7486 - DNA, 700 bp, Nannochloropsis_gaditana
agacctttcaaaggcctcggccattgcccaatgggtaagtatcgtcgacgcttactctccatgtgtatctatgcagtacaatcgagtgctccttcctgtattctatcggtggtcgtattattcgatatctgatgcgcttttctgcttagctcttcctggacctcccgtactcttgcccttacccgttcacattttcctttgatcctacagatgaagatccggctgtggttgacccttttattcgtgagatggttgatacgatagagggggagaggaagggcggggctgctttacccgcgtaatggtgcattcaaatctaaagggaaaaacgtttgcaaatttgaatttttgaaaaaagtcggagccggattgatctgtgctaccgtctggcgtccggatagggtcggtggtgggacacgccttgctattacgacatactcctgtgtatcctctaatcgcatgcccctcttgcgcaattattactttccaattggcgaaagcgtttaaactcttttggttgtcacatcttgcgaatttttttcttatttttctgttggaactattctcttgtcacatggggttccctcccttccctgccgtccccttttccttcgtgcttattatgtgtccaagggatgaatttagtatgctcacgtaaaaaaaatcttaattcccttatttatttgtatgtacctacctc

SEQ ID NO: 7487 - DNA, 700 bp, Nannochloropsis_gaditana
agggcagtggctgttgtcgctcatatggtcgtcaaggcaagagcgacaaaaggtgtggctgcagggtacagcgactggatccttgaggaaatgtttactgtgtagtgaatatggaatagaatcaagatgcggaaacatctgagaacgcctacggcggcattcaggtaacaggcgggtgtatagcaatggaataagaagaaagtccggaaaaacacgtcaatcggaaagcctgaattaccacatggaacagctgacaagttcctcaatcttgttaatgaagtcttgctgccctttcgggtcgagtaggcgggcgagggtgtcgagggagcaaggaagaggaggggatgccccggcacccttctctgctccttcaccacctcctctgcgggaagccttcctcattgttgcggctgctccccagtcccgatgtacaagcgccgtctccgcctcgtcataggcctcactaacactctgagatggagcggattgcgtaagttcatgagagagagatgtcgatgcaggactgcacggcctcgcgtgaaagccgcggcattacgcgagttcagcgactgccgtcatcggcagcacgcaagggttagggttcgaagcattgcgctggaaagggatggggaggcggacagaccggaatgttaatgaccgtgcgcccaacctatcctgctaggtgcccttggcagcgatg

SEQ ID NO: 7488 - DNA, 700 bp, Nannochloropsis_gaditana
tggcggtctgggcagtgggatcatgtgtgatcgatcacccagtatcagcgggactgattggattgtcgctaagttacacatggccgcttgtgggtaatttgagtggtcttctgaatgcgtatacagagacagaaaaagaaatggtagcagtggaacgggtgcatgagtatacgaccgagccccctgagcccgacgtcgttttcagtacaatgatcggcaaggggtgcgaagagaatgctggagtcgcagtggaggtacccccctcatggcctcaaaacggcagacttgctgtccacgacctcacgcttcgctaccacccgacgtggccaccagctttggaccggcttaattttacaatcgaaccgggcgagaaggtcggattgtgtggtcgaactggaagtggaaagactactctattgtcttcaatatttcgactcgttccctgggaatgtggcacaattataatcgatggattgtccgttcaaagtgttcctctaaagcgccttcgttcctctatggccattattccgcaatcgcctgctctttttactggtaccgtccgcagtaatttggatccgaaggaagagtattctgacgccgagctttgcgcggctatgcaggcttgtcatcttgaagacttccttttggacacgataactgatgtcgatactcccaatcatcagaaggaagcgaaatctct

SEQ ID NO: 7489 - DNA, 700 bp, Nannochloropsis_gaditana
cgtttccctctgttttggtttcaggttattgggaaagtggcacggggggtgcttgtcgcggtgggcgataacttcaagccttcaaattgcacccgttcaaaagcgttccgagacctaattgcctcgctccatcttcatctcaaacagtgcgagcatgccaatgcctgagcattggccaccaacgtcggacgaacattttccactgtgcctagattaacaagccggcatggaagcagtcctaaacggaatcgacacctgccccttcggggccctcggactcctcggctctcttactcttacaggatttgcgcttcaacgggctgtggatggtccttcaaatgcgccagtaggacagtatcacgctcaatcctggaggcgctgcgttcaaatcgaaagcccgctggcatttgtgaacgtcgttgttattgtggcagaagcagttatctatcgccgacgctttgggtggtgcgaatggatgcacataggtggggtcgtgagccctacgctattgatgtgcattttgtgggactatttcgacaaaaattgttctaacagtgccaaattgctgccgggcatgtgtcttgtggtcctggctcaagtaggccgtctcgtagcggttgtggtctcctcagcaacaccgactgtccttgatctgacagcaagtattctgcttcttttactatttttttggaaagtcatg

SEQ ID NO: 7490 - DNA, 700 bp, Nannochloropsis_gaditana
gatgggcgggagggaaagagaaggaaaagcagactctgagagaggacagggggataaaaaggcgacacattaaaacgaagggacgtcctttcctccaagaacgttgatgcgtgccctccatgccacttccagcccactttccagcaaaagacgccttggtcccggggcaatccccttgcaagcgccggaacgtcacgggcttggcgaggccagcggcttcaagaatgtattaaaaagaaattacgtgggcggtgagggagtgactcacgcatgaacacgtaccgccaagacccagccaccaggggtctgccctcaccggccagcgcgcgtcgtgcccgcgtgtgcattgttgaaaccagcttgtgtgccggcagtgcatggtggcacgtcgggggaaggtttgggacacgatgcacgggcagtgacgggcacgggcgtggtgctggcagcggtatccgcccagagcccgggaggagtcgctcccgtgaaagtgctggcattgtcgacaagcccactgctccccctgcgcagttcaacacgcatcactcgttgttgtcacattttatgtgctcatggtttcccaccatcttgcattttattgtcctttgcccatgtaggatttgggttgagagggcctaggtcataccagcactccaagatcgaagggcgaagcatcgagtcagcaacatcatccccgatg

SEQ ID NO: 7491 - DNA, 700 bp, Nannochloropsis_gaditana
agggtagcgacaagttatttttctgtgtatcctgttaagaaaccgtgcgggctttactgattgcgcactcatttccgaaagcattccatatcacactctccgtcttgtatagggaacagttaaaggaagagggacactcatttgttcacaccctcgattccttttggtaaagggaaggctaagaagacgtctaacaagtaagtatataccggtcagccatgaacggtggcagatgataaaagggcacctagttcgggcaatgctttcactcgacagggctatcgcgtggcagtgttgagtaacgacgggcctgtcgcctcacagcaattactgcagctgaattgtgtcgcttaaaagcgtggtacctcgtttgacctttgtatgtgtgatcgatcacattgcggctatcatatccttttttcggaaaagggaaactgaaattgtgatgataatagtggcagttctgtgtagcgcttgattttagttgttcagtgccacaagagctggcgagaggtgtgaggcaaaaaatctgaaaaaaatatttctgtcgatcatgtgtgtaatagaaatcgtaccttggctgtcatgccgtgtgtgctgaagctcgaaatgtgaatgcgccctgattccgctcctcttctcgtgttgcctgtactttctgacgcatggagcctcactttcttcctaggcctcagccatg

SEQ ID NO: 7492 - DNA, 700 bp, Nannochloropsis_gaditana
cgcctgcggacccttggcaatttcgacacgctcgatgtcgaacagttccacataggccgagcgtgcgcgcgagatcgacacgccgtcctggaataccgccacgcgggcttcgccggtggctgcgccgtcgtcagaggtgatgccgcggatcacaaagccgggattgttcggcgactgttcctggacttccaggcccggcacgaagtcagacaggtcatcaaactgctcgatacccagctcagacaggcgctgactgttgaacgctgtcagattgatcggaacgtcagccagcgactgttcgcgcttttgggtcgtcacggtgatgacatcggtcgtggccggcgttgcggactcagtttgagcgattgcaggcgcggacacggcggtcagcgcagcgcaagcgaggagatgggctttcaggcgcatggggagtttcctcttgataagacggcaagccagtggtctgacatgcgggtagctcgccgatacctgttcatgatgacgcttccctgacgaagcgatgacgggtatttgacgcagcgcacaactccgcccggcgtgacgttttgatcacgtcacacgcctgttacatggccaagcaaaggacagcccgcctgtgtctgactccagcccggaactctcggccgatacccgccaggcccgccctgaagcttcaggggagcggctcgaccgctggatg

SEQ ID NO: 7493 - DNA, 700 bp, Nannochloropsis_gaditana
tgggaaaattgcagcactgccagcataaatatggtacgctaaaaataagagaagcccgagaatttaacaccaagtactttacgaaaatacagcgctgggtataagtccgccggcatgacggcaacatggaattgaagagctgcctcccctacctggacgtgacagtgcatcccctcaatttttgtgtgtagtggccttgcaggtggcgcaaaaccttgtacgctcgagtatctacccgtccaagccgcacaggccgccactgatatgaaaaatctgacatgaaagggctgtcgatgtgccatgccaggcctggagcgtggccgtagcctccagttatctgaaccactgggaggaacggatggctggcaaaaatgcatatccctctttgcgtatcctgttgtggagcatgcgtgtatatcacgtggatgaaagaaacgctttctcctcgtccaaaaacgatgtaattgaagtttagaagggccggggccatttaattccttgtctccgcgtggtgtaagtcgtagcggcaaagctcgctcgaggcgagaagtatctttaccccctgactctcttccttgcgttttagagccgcaatttatcttgattcacgacgttgatgacgactctcatatctgaaaataaaagacaggcagtatacgacgacagtaagaaggattgaggcaagggagcgaaggacatg

SEQ ID NO: 7494 - DNA, 700 bp, Nannochloropsis_gaditana
aatccaaggacttgatttgcacatttgcgttccgagacatactgtcggtttcgtatggccttgaatgtgacaaatcatcgacaaaagatattcagctcttgcattcactgccacacttgcacaaatgctcgtcccctttttcttgtttttctcgccgcctacacgcgcatatccccgattaaacctatgaaacagccatattgtattgacattgcatgatttgtgatgtttttctcgatgaactggttttcgttgacatccgaggcaggattataacgtcctgtacgttttgacggctacttgccaaatgttcaaggcgaagctgtgttaccttttagaggccgctgggcagagcaaatacttataacgaaaagtcaacgtcctgcacgagcttatacactgcctaccgactgttaacgcaaccccacaataaaacattttacccctctctaagtggcaatacccgaatgtagccagcgataagtctctctcccccacgcgaggtggattttgcgacgtccctagacacaaaaacaagtctctacatcgaccatcacagcgctaatgaacctgctatgccagggactaactccccttgttgtattacgcaggctcgcggggcaggaggtttgcgtggctctgacggcgatcaggcgcctggtcaagccgcgcacctgggcaaaggagacacagacaaatg

SEQ ID NO: 7495 - DNA, 700 bp, Nannochloropsis_gaditana
cctttttgttctcaattaagtcaaaatgataccagttgttgcagccatcgcactcactccgccgttccactcccatcctcggggtcatcggccgtctcgcggcaggaaaaaatattttacgtagaaacgcgattgcattccaatacgatgtctcacaaacgccaaaaacatgtgttctggacataaattctcatggtactgggcacaatctacattttcaggaaatatagtggttggaatcacaaaaagggggaaagtaatgacgcgttatttagcatggccaaggcggctcgtctatggtagctggagacacggtcaaggcagcgctttcgccacatgtaacaagccttgccttcgcttcaaccgcatacggcgtttagcaatggtatgcataagaccctctcattctttttccaagccaatctctttatggctccaagaccagctcttcaagaggtttacttcacgtcaagtcctgccctttcctacgcccacgcatgttcaagtcgaagccaccgaaccacaaatcaagcctagtaggggtagtcacgtagatgggaagcaagtggggttatcagaagctgctgagacggaggaaaagcagggaaaatggtcatcacctggtggatacgagccatttccatgggggtcagcgcccgaggctgaggtatcggctttcgggcctcaggaaaaatctatg

SEQ ID NO: 7496 - DNA, 700 bp, Nannochloropsis_gaditana
cacccgcgtcgtgtcggtggggtgtgtgattgggagcaggaatgtagatcaggcctcgtcatccgttgaaactcaacacgacaacgcgataacggcaagcccgaggggaaaaagcgacactgacgcgacacgtagggtcacacagcttgccacggacaccgccgcccatgctcatacatgaatctacggctttacatctggatggatacctttcatgcacggcaggtcttgaagtcccacatggacggtagttgtcagacactcgagagaaaggctggcaaaatgagcgcagggaggggacgagaaacatccttctcactcaagaacaacgggtgggaaaggacagttcaagacaggcgattgccacagggaagctgtcctgaattgagaatagaggatacgtagagagtatggtgtggcaacgttggcgctgccaatcggattctcttttggattttgttgggatatccatgacttgcagcatccactcgttcaagccgcctcaccatgcttcaactggaagatacctcacttttccaattgcaaacaacgcgttatgaggctgcgtgagcatatgtgtacaacacgctcacatcatgttctagtacgattggaaggaagcatcacataaagtttaccattcgatgtgcacaagaattccctgacatttctttttcccccgccttattctcgtttcaca

SEQ ID NO: 7497 - DNA, 25 bp, Nannochloropsis_gaditana
ggaggaggaggggggaaatgaggaa

SEQ ID NO: 7498 - DNA, 700 bp, Nannochloropsis_gaditana
atatttttgtgtgaatgtagtatatgtgctatatcagctcactaatgctatatcagctcactaatgctattacagcgcattgataacactccaactttctgtagctgaaatataaacttagctccggtctctcgtccaatcgagcataatcgctcacgcttttcgtagcttgtgttgcaaatgatagcagtaacgtgattgaactgtggcttaggtcttaaaagattctgataaaatgtttcaactgacaccttgaacggcatattagtgcagtattgaaaagtccggagtggggaagaccgtattttcctcccggacacctcgtccgtcaccaaacacaggcactggcccattatgcagattacagtacctacaccattcttcagatactacagacagaaattaatggagatattataagattataaatctacatggttgtaaaagtgtgcgcccgttgcaagtgtacacattcaagacccctgcagtcgtgtaatcgaaccttattgagaaaacgattcaaaaacatcttttactcgaagcctttcttactggctctaccagggctctaatgccacggagagtagcttatatgtctggaaacaatccacaggcgcctactctcaggtcacttctctggtaacactccttggaaatgaagcctttcaacgatacggactatcacatataaatcaaaatg

SEQ ID NO: 7499 - DNA, 700 bp, Nannochloropsis_gaditana
cgtggacctcggcgactcctctttgtccttggcccctaaaccgtcgttgcgtcgcaacccgcgtcgttcatccgggacgttttccatcaccggggcccccgcctccggtgcgacctccggcaccgcctcctctccctccatcgctcgacccttcccaagctccacccctaaactccacagggtcggcacccctggcagatcctcacgtaaaagcgggggagggagggaaggaggccagggggggaatgggaacgggcccggtgccaactacagcaccgtttttgccgaagccgagaccgacgatttggaatacctcgcggccgagatgaaaaaggggggagaaggaggggaaacggcatggcgttttgggtttgggaaaggtttcgtgctctttctgcccggcgcgtgggcccctctgcgcagggcgcgggtgcggtacgtgttgctgcaacttggctttcagggtcagatgcacggggggcgagtgtgctaccgagtctcacaagccagggcaggggagctgaaaagggagctgtggcaatggcgggcagcccgggaggaaagggatggagacggagacgttgcggacgaggatggacaagttgccacgtttaaggccacagagcctcgcgaccagaacgcaacggaaagtatcagcaggagcagcaccagtcgaagcagcagtggcagtggtaccatg

SEQ ID NO: 7500 - DNA, 182 bp, Nannochloropsis_gaditana
tgtcggcggggggggaggaggaggaggagacatactacaccctctctccctcgccctcccccttctcctcctccccttcctcccctccttcctttcccctcgggaggaaccagagcgatgctagcgacctgggcctgattgcctacgaattgataggaagccaagaaagcatacccggaatg

SEQ ID NO: 7501 - DNA, 700 bp, Nannochloropsis_gaditana
aagctttttccaaacagaatttcggggagtggaatgaaattatggcctgcgttgctcagatcagctgggtggtcgcccgaggcagaggccccttcttcaccgatgccacttctagtgctctgaccagtcgtgctgggacagccagcgccaacttcagagtaatttctggtgtcatggctcgccatcatcatggaagcagcgtccgtgaaatgtacgctccaaaagtgcgcaatgcgctgtgtgagcgcctccctctcttggtcactcaggatgggccgtgcccgcgagcatacttgccacccacccaggtcaatccttgtactatcttcacttttctcgacactggctccgttacgctgtccaagagtgcagggtttgttaatataaggtcgcgaaaagtatcaagagggaaaatgcgaggaacaacgccatgaggaggtcagaaagaggacattctcacccgtaggacggcttcctctgcaacagtagcacctggcatcgcttgagatcttcaacagatacctaccacgtaaataatttgtgagaaaggagcatgttatgttgagctcacgatgtgcgccttttcacccagtcttcggtctcctagttccgatccgtccgccggaagacttcaagtggccgccctacccaactgttccatttcgtgaagccaacacgccttacgcgtgagcagagaatg

SEQ ID NO: 7502 - DNA, 700 bp, Nannochloropsis_gaditana
aaatcatatagtgacatcgcttttggaatacttggatgtacctttatctgtcggactttcttccatggaaccatttctttgtcggggtttgggcctttgcttggatagatgaccgaacaccaggaagcggagtaaagtagtcgcataaatatgggcaccactggaaaatctaaaatgaattatacattacaatgcaaaagggaaaagagacgctgtatgtcccccaaagacttctttagcttaaaacggtgcccgtatggctatttggggaatcatggcgtggagggatgcgtctcaaacgtttttttgaattatgaatgcttcgacaacaaaaaattaaatggcccgccaggcgctctagaaagtgccctgttgggctggtgatgacttacttaatgtgtaaacgacctcactttctttaaaatttctcccggcatgtgctgcagtttagtgctcgtcccttgcttgagtactatgtggtttgttgttcgatgcgacgcgtgattacctcctcttacttgccagtccttgacggaactttgctgattcctatctgtaacactcaagaggtagaaatagaagcacctgtgtcgaacgactagaaacgtccttacatttacgctaaccattacggcaggacatcatctttggctcctggacgagaaggctggaggagggcgcaaacaagatttagacgatg

SEQ ID NO: 7503 - DNA, 700 bp, Nannochloropsis_gaditana
ttattcgccctcatcgggaagagctaatcgcgtttgatagcacgaaaggggcaagctttttcagctttatctcttccatacgtcaagatagccgcacctgttgacaaaatggatgaggcacctttgcctacaaggacaccagccacctcaacatcacagccgacgtccggggaactcgtccctagctcttcttcgggccccgccccccgacgacctttgaaggtgattcttccctccaactccaagaatgcatttcctggcttaaatcaacatcgtagagtgtaaacgcagtgtttgctgtcgacatcggatacacaaacggtgaagattaatttgtagaagtgaacgtgcctcgaagtcaatcctctccacccgcgggggtatcatcaatgaagcatgcttacagccttcccaaaccaattaagaatcgaagtgacttagtatacacatatatcttataccttcgcactcccactttaacattctttgccctcagcgctttgtcagcaaggtcaaacgcattcctgacgatatccttgaagaccccgccttggctcaagccatcgcacagctgccgtccaactacaattttgaggtgcacaagacgatatggcggctccgagaagcgggagccacatgcgtggcgctccagtttcccgagggactcttgatgtacgcctgcacgctggccgacatcatg

SEQ ID NO: 7504 - DNA, 700 bp, Nannochloropsis_gaditana; identical to SEQ ID NO: 4696

SEQ ID NO: 7505 - DNA, 700 bp, Nannochloropsis_gaditana; identical to SEQ ID NO: 4697

SEQ ID NO: 7506 - DNA, 700 bp, Nannochloropsis_gaditana
tgagcgggactcgctggtactggcgacgtgagggaacaagcgtcgatctttcctcgccgtggcccactcccagcgatcgtgctattgtgcgctgaggtcagaccgcgggtgctcgaatcagaagacattcgtgccttttcttgaacgtcccgacattcggacggcgtcgggtgtcttggcacttgagggcgttatttttcttggcatgttgtcacactcgcgggttaatcatgtctggtgtcatgttgttatgtgctttagaccgcaatttgttgggggttggtggcgagcgggctttggggagccacaatttgggcaaaattaagcttaacgacaagtcctttcccctggcatcgcgatctacgctcagggaacacttttcgtggtacgtttcgtccaagcactgcattaacgcaggattttgtcgagagttggcaaggctgtcgttgcgttgcggttttcgaggcgaccctcgaaagatctatcgctttcccaggcgcaccctagctgatttccttgccacaacacgggctatcatccagcgctgccagccattcgcgtcactacagctacaagcacggctccaccttgtctgcaaggggaatagccacatacctgcttcttctggtgtctgggtcagacagggagtgtgtggaacacttgtgacagggtaagacaggcctccccgaagaacgaaatg

SEQ ID NO: 7507 - DNA, 700 bp, Nannochloropsis_gaditana
tcttcgaaacataccttgcccagacccaggtccgccatagtggcgtatattttttaatgtattgcttgcttataatcgggaggcctgtgaacaaggaaaattttgagggatacgttcgttaattgcctacgcgtgcaatatttttcagacggttcgaggcacgcaaagaacaaactttcagggtgaagatgaaaaaacaaaggacgagtgagccttgcaaagcgtgcgcagcaagcaaaggtttaaaatcaacacgtacgcaagagtaccacaggcaattggttgcgatggggcgcattttgttcagactttattcagcatgggctcggccgtggctgtcgagcgacctcctctccctcctctcggggagaccgttccgatcttctcaaggttcacgcgggccgtgtctggttttgggccttaagaccatgaataatattgtgctgtcagacaggaccctaatagagatacataaaaggatttggaacacagaaactgatggttggccgcacaatgaatttcgttgctcggcatgatagggttgataatgtttttcgctcccgcgtcgttccgatcgccttctgctgcctcgcgttcttcaaatatgttgacacccgtgcgcacgcgtttttttttacgtcccttcacaatccactcttgaaattcacacgaattgaatccaggcaacacaaacaatatg

SEQ ID NO: 7508 - DNA, 700 bp, Nannochloropsis_gaditana
  misc_feature (115)..(507): n is a, c, g, or t
gcgcccgagcgctcgctatacctctttctgtacactggcgcccagcacggctccctccatccccatgccccctactttgtgcccccctgagattcagtcacgggcaccaggctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgggggcggccgccgctatcaatctgctgggtctgtcggacggctttgacgccgtctacggctccagcgctggggctctgatcgccgcttttttcgtctcggggcaattaaacgggaccatcatttattcggacgtcctccctgccgcaggcaagagattcctcgaccgggcgcaacttattccggccatg

SEQ ID NO: 7509 - DNA, 700 bp, Nannochloropsis_gaditana
ggttacgttgacggtaagtgctgtctggctgctgcgatagaagcccgtggggccaaaaaagatgcccggaggaaggcctggctgcaacttgcgtaagcatcaaaccacttgccttatacagattcattcatgtcccttgcaaacggcaatctgcccctcgtttccatgcttgcaatgcctccacactctctcctgctccgttgcaaggtttttaaaggccagctcgccctcagcgacagcttgctcgctttgcctgccaaaccgttgttgcccttgcgctcgtacactgacttgtctctcaatcccatgcctcttgccgctccacactctcctttccgcccacacgtttataggaggccactgcgtgggtggtgtcccaggtgattgtgaacgagaacaagctttcggagccggaaaggccggattgtcactattttcttgccaacgccaccgcccgctcgccctatcctattgcaacctgcggcaccgacgttactgcgttccatgaagcgtggctgtcctggactgggaaaaaggaacatttgaaactagttgaacgattgcgcgtcaccatttttattgttctagaacgacatcaggacatctgcttcgtcggtaaggccggcgactgccgcccgctggcagcccctccctcctaccggccgtagggtggtatccctaccagcttactttagccatg

SEQ ID NO: 7510 - DNA, 700 bp, Nannochloropsis_gaditana; identical to SEQ ID NO: 6395

SEQ ID NO: 7511 - DNA, 700 bp, Nannochloropsis_gaditana; identical to SEQ ID NO: 6392

SEQ ID NO: 7512 - DNA, 700 bp, Nannochloropsis_gaditana
gtctgcatttgttggttgttccggattgaatttccgtgttaaaaaagaaatcgatacattgttccatgtttgagtctgtacgactgacaaagaaattttcatgacactgtttccgagttcgcatattacctctgatgcaacgcgcaatccgcttgatagctttgtcacctccgtcgcgggagtattcacctccaagctcctccctttgtatgccgataagaacctttcaccctagatacgagtgtgcgaaaaggaacatatcatttcgtcgtgaaaattacttgatggcctcggtagatagatagatacttcgcataccttgatgccgggtcccggcaagacgagggatgatgacgctgcactccgccgacgcgagagcatctggaggacattcttactgcacttcatttactcagtagcgcaggacgtctccctgtgcgtgggggcgtgtgctgcaggtgagagtgcgacgggacggcatgagatggggcacctaactacgaacttgggggcgcagcgtgtgatggaaagcaacccctcgggtgacggccctctcagaatagttgtattgactcccttcctcgtatgtgcgatcccaccgctgtcaaagccccgtattcgttgcccgagatgtgtgttatttgccaaaatgtagggattgtaggcccttcctaaccaatcgccatgttttatatgaaag

SEQ ID NO: 7513 - DNA, 700 bp, Nannochloropsis_gaditana; identical to SEQ ID NO: 6595

SEQ ID NO: 7514 - DNA, 700 bp, Nannochloropsis_gaditana; identical to SEQ ID NO: 6596

SEQ ID NO: 7515 - DNA, 38 bp, Nannochloropsis_gaditana
tttcgaatgacgcggccctggggatgttgacgacagtg

SEQ ID NO: 7516 - DNA, 700 bp, Nannochloropsis_gaditana
gggtatcgtggtgtggatactattgtattgccctgtcggacacttggagcctgaaatcaacattcgcggattagaatcgcaacatgaatgcaccagcttccttgcctaacctatgcttcaactttcgcatgcacagacaagaaattatgactgtacaggggctgcacttcgagcaaacattgctgatcttaggccttcgaccaaaacagtgccttctccctgaaattttgcactccacaggggcataatatgggaatgttgataaaaatgccagacaatattcgtaggaatcgcatgcatggtgttattgggccagcaatctacttccctattagggttaatctggagcgatctccactcgggttggcgagcggctgcggtcttccgagtcaattgtcacagcgatactgagaccaaacccaaaacgctttccacgacccgtttgctcattgaaacctccatacaatactctgttcatactgctatgtcttttaaatgtcgacccaccctgaccctctttttcgcattccacatcgctatcacggtggatcagtggctgcaagagggaaaaggctcggatagggaggaacgcacacgccgatcatcagggtgtgagtcaaagcgtcttcctcgcaaaattaacatccttgctcttggccagcactcctgattgcatctcacctgcgacctttaaaccatg

SEQ ID NO: 7517 - DNA, 700 bp, Nannochloropsis_gaditana
tgtgtgttgggaaaacaaggaaggagctgtgggtccatgaacgagggctgaatgtactgttaaactctaagaatggatgtattcgtcgatcaggatgtctcggtattgaataggagttcgtaaaaggctagttgggttgaaaagcgccaaggtgacggagagagggggccgttgccaaggggagggtcgattggttgagggttaaatatgaatgaattccgacgacaagtgctttccacgaggtcgtatggcatacagttatgacaagggtttcatttccatactctactgtgctcttccgtgccggtgttttgcaccaaaagtcccccgacctgaaggacgtggggcttcatgtatccacagcgtcgcgctggcatccggcgagacggtatggaggggggtcgtggtaaataatggaccctcaccgcccgcttgcatgccaccgttccgtgtcaggaacaatgtcatgcgcgtactatgcctctctccgttagtctacgtgggcgcgcatgccatgccagcgttccggaggtcgttgtgctgaatttccctcctagctaggaggtgctatcagtggtctcctgctcggcgcccgactactgtcccgtgttgattcagtcctccctttttctctcccaaggattgtgttctcggctaaacgatacaaggcttgttacgctcgtaatcggcagtattcatg

SEQ ID NO: 7518 - DNA, 700 bp, Nannochloropsis_gaditana
tgacggcccaagtggggcgtgggaaggcggaatccagcgaggacgtggcccaccccccccgtaggcaggctgcatcgtggagaccatggcttttgcgatacaaattgggaaagtttcatgctgagatgactcgtaaagggtggcctcgccgtgagaacattgcgagcaccaaaaatcgcaggaacatggccttcaatgtcattctactatgacttcgatggccggaggttatgaatggctgaatatgcggctggggcagacatttttcactcatccattttttttcccttctattccctacaccttttcgatataggggtaggaaaacatggtatttcgtgtaaaattaccattgccgtcctcggcggacgatgtatttatggacgaggagggcgtgctaatagacatcacgagtccagtcccatggggaggtacgaagtctgtgaccacagaggagacttcgattaacttgcccgtgcgagaaatagaaacatgcggccttgcctactttcgatatcagttgaagagacaggcgatcgaggcaggagaggcagggagcggaggctttgatccatgtaaacgcctcagagacgaggccgaaggggaggaggaaataggggagggcggggagggcggctcggatgacacgacattccggtttcccaagaagaccctgacacctaaggatgtgaagaagatg

SEQ ID NO: 7519 - DNA, 497 bp, Nannochloropsis_gaditana
tcgtgtcgtgatgatggaaaggcggagagaaagcgaggcgcgggcatacgccgaggggacttgcacgggggggttgacgcgctgaagatgtatatgtatatataaattccacgcgcgtcctggtcgagtgttccgtgcacgcgctagggattagccacctatgtgtcgtgtcaggcctcggagtgagcgtctgcctttggcatttgaataggtgtcaccttgccgcatatagccaacatcagaccaagtcagcctcgtcaaacccccccgacactgaaagttgataattaagaccctgccttcacgtacagccaagccacaaacggacagtcggacatgcacaatccctgccgcgtcccaagccaagctaagagcggccgcatgccgcccatgggattctttttctcccctccccgcacgtctcgagttgaacgttttaacctcccggccttccggcaccctgtcctgagtataccgcgcctagattcttccacatg

SEQ ID NO: 7520 - DNA, 700 bp, Nannochloropsis_gaditana
ctcattccgctgatcttgcgccagtgacatggacgacatgttcaaacactagatttttatacccagtcagccttgtcgttagccgcttcgctcttgcacacgtcgaggtcgaatggaaaagggccggcaatgatggggagcaaaggcgatggacgatgaagacaggagaggaattttacaacttccttcgagctgcgtcacaaaagacgaaggcaacctgtgcggaaacgtcaccaaaggtcacaagacgcaattagaagggttttagtcacgctttggtgagaggggaagaaatatatggccgttctgcctcgcgcataggcctgtattcttcctattccttccctctgtcgccgtcatcgtcatcaggggggaagggcatatgatgttttacatacctccgccagccgccggcaccgtcatctcgggtgggtccgtatgatgctttacataccgtcgagtgctacatccgagacgccctggaccgtacgactaagatcctcgcattgctttttgattggggtacacgctcgcacgtgacagtcgccatgaaaattaggctggcgtctatgtgcgttggcatgtcgaaagttgtttcaagccgcatgaaatgacgaattgtttcgaataaattcggagcccttcattgacaccctttcatacacatcctgtccatttcctcatcactgtcatcctcaac

SEQ ID NO: 7521 - DNA, 700 bp, Nannochloropsis_gaditana
agacgcccgtgtcgcatgacagcctccaccgctgcctgaccaccctctccaaacagctgccgcgctcgaagcaaaaatttgggaaagcggaggcgcatggtgactgcatccaaatccatttgatagtaaatcagaggtttggtatgttttcgtagcatctcatcagaagtgggcatcgcaacgaccagaaggttgtgctgtaggaggataaccagcgcctccttaatgaggccaagcttgtggaggtttccattcctgttgtcagagtcccgccatatctccgccaatgtgcagcgcccccgacgcagaatgtatgacccaatgtcttgcacgacaggaccgaagtgctcgttcaaaatgttaagggccagcttatattgttgattggcggaggaaactccccccgggtggggggagacgaccatagggggaggattgtagcgtcactgccttgaatttgagagcttattttcgcacagactgggacccgtcgtgaataaacgatttctgcttcggtttgtgaagagggaaactgaaggtcttgaggataagttattgtcgaggaggtagtagtaggaggtcaaggagggggcggccgcagcctttcctcagcgacaccagtgagggcaaagagtagcttagttgcatccttcctcaattgacgcaacatgataaaccagattctcatccatcacctgtg

SEQ ID NO: 7522 - DNA, 700 bp, Nannochloropsis_gaditana
tcctctcgattctgaacagctctgcgagaaactatagcttccgtccttcaaaatccataaacgacgtaaggcgcaaggcgagcggcatcaaaagcacggcaagttgactttgcggtgcccggtatccgtgtcgggctctcaaagtgctctcgcctcgccacttttcgtccgtctccccgccgccacacagagccgtcagcggggcgtgggcgtgcatggccaccgttcttcctcctccagacccggtctctttttgttggcgtggttggaagggcgtggtcaacgggatgttgttgagatgtaggtcgtctaaaactcatgtgtcgcttttggtggtgactacggaaccccatgacgcgggcgtgcgggttgggcagccatctccccctcctgcggcgctagcgaaggtcacgctgtttggcacgccactcacctgtcttccaccttcactttgcgcccacaaagaccacagcgtcaccggcagctggttaaaaagggtttgagtcgctttaggaactcattccgccagctacggcttcctcactttcgcgaacaccacttcaagaaacctctcaacaaccctttactgaaggtaacatacatctcttcacataaccagcgggctccgagtgcacgtgctgttaagcctcttgacttagctcacacgtcttctttacccctggctatccgcagaaccatg

SEQ ID NO: 7523 - DNA, 700 bp, Nannochloropsis_gaditana
acgtgcgcccgtcctccagctgcttccccgcaaaaatgaggcgctgctgatcaggggggataccctccttgtcctgaatcttctgcttcacattctcgatcgtgtcactgggctccacgtcgagcgtgatggtcttgcccgtcagcgtcttaacaaagatttgcatcctgctgtatgattttggcacaacgacgcggttggagggtgagggagatggtggtgagacatcagaaatggagagaataacggtagagaaaaaaaggaacacacgcgcccaggatagaaccaggaccacattccaagtccctcaccagcaacaagagggacaccacgtcggtgaagaggtgcgtgagacagaggacaccagacaacgtgcacaaagcgtcggaaagggaggcgaccgcttcgctggaggggggccgtccacagcctgcgcccaaccacacacattcctcccgcgaggctcaagtgccatgccgccgagtgccatgctcctgcatccggggcaggtcgacgagccagcatggtttggtcgccgacaacgcagatttgatggagcttgggcatttctttaccggacacgtcgcttcttacatttttacattccaattcagaggtcacacccgcgatcgagaaagcagagagtcggacccccttcaagcaggaaaggcaagcaacatacccatcgttaagtctgatg

SEQ ID NO: 7524 - DNA, 700 bp, Nannochloropsis_gaditana
gcaattgcttggatgagcgggaggacgcgtggagacaggggaaagatgcttcttccggcgtcgagtagcggatgcgaggcagccgtggcaaagcgacaaaacactccttttcgagaagacgacagaagctacagcccctgttcgagagaaggagtggtgataagaaggggcttgagggcgtagaaaatggaaaggagataggctgtatatcaagcaggcaggatgataaacggcgcgcctcacaacttgggggctgaaggattctgagatgtcgtaggagtatataatcgaggcgggaaaaggcgctacggcgggacatacggggaaaacaattacacaaagaccaaggaagagaacatcgcgtggaaacggtgcttgtgcatgtgctgaacaggcatgctggatatgcgtgtttatggcgcgcctgatgcgggctccacctccagggcctcgcccgatgtgcaggcctcgcgcagtactgtccatggctacgagtaccacggccaggggtactgactctgcggattcgatcactacggagcataagggatacccgcagtacctgatagcgcgctccaccttcaccatgtgtgatgcatcctagccctttcgtctttgacttttctactcccatcactgctttcatctcttcaggtggtgtcctttcctcgagaaatttccacagccacgcgacgacatg

SEQ ID NO: 7525 - DNA, 700 bp, Nannochloropsis_gaditana
tatacttgaatgaattacagtgcgtgaggagaggcttgctgtcggacgcagcgagaaattggacctacctgacgggacagtatccatgccaaaacgagcaagccgtttttcgatggatttcaggtcctttttgagggtcttagagactgttgaccggcttgtcgtgacgctgggcgcaagcagagcctacgggaaaagtatcgaggcgagaggagcagaacgtatcagcgcttccacccagggttcctacgatagtagcgtgcaagttacctcgttaagattactcataggaccggtcgcatgattgaaatggcggtgtaaaatggaggagctcgaagcaacgtgtctctgaacaggccgggctgaagtgaaatacgaacgtggtattctctggaagataccgcaaatttgcgacatgataaatgcaaattgctaccagccttatctgtgtgatataagcaagacagtgaggtaaaatctagaggaccgttcaatgtgagcatggcttgggttgctatcttccttttccttcctgtgtccggaggttttgtccgcgacctccgaggtccgcctcgccatccgtgaggagctcctcttcaccttgagcatccaggcatgcccacgacttaaaagtaaatctcaccgcattgactcggaacaccgggacacacatgcagtgctcgtacaaggcccggacatg

SEQ ID NO: 7526 - DNA, 700 bp, Nannochloropsis_gaditana
cgcgctgacagcccgctccacgctcaacctgttcataccatctaccaaaaatgcctttctgaatggccacgcatggaatttgtgctgcgcctgcaccagcaaggctctctcttgcgagcagaaaccaacttgcgtgaggcctgttcggcgcttgcgttactgaagcagatagtacaatctttggcaacaacacatggtttaacccaacgacacgggtgaaggcggcacttgcatggctttaagcgtgggcattccatcggtcactgctttgcggtcgtgcgacatgcgccttggccggtgacatgaggggactgggaagccgggcgtggcatgaggaggagcgaggacagcggctgtccgagggcccttcctacacttcctttcagaaaattcaccaggtcctgtgacactgatttccgcccaccgtggacgccgaatgcataacggggcattgacaatttcatcacgacctataacttcgcaggtgtcgtctctcgaaaacgcaagtaggatgtactgagaacggtcaatgttcgcaggcaacctcccccttggtctgcttgttctgacaatacccacggcacttttcagtccctcccacgttcttagcttccgccgcatgcgcaggacccttcctactttcatcgtgacagacctagtaccatcaagagaaggttgggggcggcgatttatgacgatg

SEQ ID NO: 7527 - DNA, 700 bp, Nannochloropsis_gaditana
acgttatcagcgtggtaaaacatgtgccaatacttcggaacggggcttcttgcaataaaaatggtcaggcaaggtctcactcttggccctgctcgccgaatctccaggcggtgatgcaagagagaccctccttgggatacgatcaggctcatgccattggtacgcggattggatggaagcgctccttagaacctgtgcatgatagagtgcagataaaaatgttgctttttgggtcgttgggatgcgatggaatattctcctgcggtccaaaggttgatcataaggtaccataaaaggggtaatctggacaggaaggaggtatagacgagctgacacctcggtcacggcaggcaaaggggcgagcacatgcaattcagtcttctagcacgaaatgctgagcagggatgtatgtccgatgctgaaacatgtgtgtccatccacattctcctcaacgcaggcttcgcatattctcgtcacgcaacgacaggggcgtcatatgagtctcatgctatccttccggtgcaacatacgcacgtcgctgcttttcaatcgaccacacctttcgacacagcttgcgacggctccgtcacttgtgcgccattccaccgtgtggcgcgtagtgcagaatgcgattcaagaacggcgggcctcgaaggaagaggagcaatttcaggcagaactggcaagactagcgagcatg

SEQ ID NO: 7528 - DNA, 700 bp, Nannochloropsis_gaditana
gtcgagaatgagggtccggaaatgaagccctagacagtcacaacacgtcctcttccaatacatagacgtcctgatataaggacaacacacgtcagcctttgaagggcccctggtgtgcttgaatggggcatggcgcgggggcgagtcaacttgaagcaggtggcactccgatgagaacagccaccaccctctcgccaccccttgtccgctccacccagagaaaatcaaggcgcagaagaactttattcaggcgggccacacgtgctccatggcatggaatgtggaaacatgcgattcacaagcttgaatggggaaaaagtcatgaatgcaagttgtaaatgcgccggcgttaaatttttggcccgcgccgaccgactggtgatgagatagtcccagctgtcctacttgagttttccttcaaccatcttgacgatatgcacgaggcgtgtttgtacgtgatacggtgtaatttgaagatgaaacattgagtggggtagagtgtgttcgcattgccgtgcgcggcacgcgctttggctgagcgtttggtgctgccacaggagggaagacggcgcctcccgcatatttgatgtttcataatcgaccatgcacaatacatttacagtaaaatagacaatcacaccaacgtatacgtgggtaggacctttgaccagcccggtacattatttgaatcaacactatg

SEQ ID NO: 7529 - DNA, 288 bp, Nannochloropsis_gaditana
catggcaccacagaacaacttgtacgtgccggggagtgaagaggtcagctgtgcgctttgcaagccctcacatgccatattggtgccgtcatttctcccgttgtactgcatcaatcacctccctcgtacaagacggcaatttatgcagcatcgtggcgtctaacatcgtcgataatatggttcgatacgagtggcttctccgtacctgatgcatgacgtctgtgggccggctcgataagatccgaaggcttacgggcccatctaataaagcgactcaagacagccatg

SEQ ID NO: 7530 - DNA, 700 bp, Nannochloropsis_gaditana
acttttgatgctttgtcggaataaatggggacggtaagcatcatatagggataagagcttgtgtggtgagggcagagatctagacgacgcacaggacttaataccttgggacactgccgatgccattggatacgtaacgccgaaggaaaaggaaagcatagtcactagccacagcccaggcattactatgtgtgcatatgtgggatgtacgccaacgttagaccttcagaagacgaaatccttgttaagggggggggactgggttgtagtaatcgtcgtttaacctccccgccagaccctcttacgcaagacacttcaacactaaaaatgtgggtgtcggagtctggaatgccctgtcgatccaaattgctaaatggagcttcatagtgtagccggagttgaatgaaccagctagagttatcaagcaacttgtaaaggagcaggtacgccgatcaaggtcagcacgattgccacctcagcacgttcgacaggctgggccgccatgagacataatgcgatgagacttataaacaaccgtaagatttggcactttatgaatctgacatcgcttatcctatgtcctgcaggcttcaagaaaccttgcatgccctggaaattcctattgaccctcgcactagctatctccctatcactggcgtaccttccgcggagtgcttcctttgtccgtcctatcacaatg

SEQ ID NO: 7531 - DNA, 700 bp, Nannochloropsis_gaditana
actagcacatgattagcattcttgtcagacaaaccgcgaaatcgtccgtccaccaggataagacgcgagcaaacgcttcccggtgcacttgaacccccagggtgggtgggacagaagatcggatcggtgacgtatgcgtattctgctggcaaagtttcgcgccttgggaaggtgaggtgccctccccgggccctggcgcggcaaaatgggacgcgcggggcaccgaccaggcctgtgaaagttggcgtcggtcttccgtcatgcattgcattcgaatgatgacggtatatcgtggcgtggggggccacagggttgcttgataggaaaaacagctggtgaaagtcacgttcaaggttgccgccgccagcacgcccgctcgcttcgagttagcagttgtgatctttgcgcttccgaaataattctgttcgatctgggcatgtcccggcgtgaaatgtttgctgagccctggaatgtgcatgtgaagggtattatagctcggaaggatggttatacttgtcccttaacgtattttttatcttttatgccaagaccaagcagacatcacgcccagagcggtcacctgcggttggagtgaaacgcgctgtggtgctagcgcggaccgtccgtgctatacgaccgcattccgaccttaaattaccacacataggtagttaatcacatcctcaacatcttctctatg

SEQ ID NO: 7532 - DNA, 700 bp, Nannochloropsis_gaditana
attgctctgttatctagcagtgtctagacatcccggtatcgccatgtctgcttcagctcctcgctaacaggaggaggaaggagggcgggttttcctgaaccttcctccctcttggcaagccaaacacaaagttttcgtgtgatggtttcacgaaagataggtctcggtaaatcttacgaagcgattttgcataacgtagctattggccgtactatcaagaagagggttgaaagaacgcctcgagacgggggcgcacaacgcgcggcgcgttcgctgtcgctgtgaggtactcttcattccctcgttatataagctgtacactcgacttatcctgtacaaagacacttgtttacaataattgaagtccttgaattacatagaatgtcatgaaggagaatggtgatttcaatctcctctttgggcgttctaagctcgttcgagactccgtggttcttcatgctgttctcattgcaaggcaggccttcaaaggccttctgataatgttcttctttctcgcctcacaaatttgtcaataaacttcaaacgcaggcaaaaaaaaaacaattcacggtcgccagttgtcttaagtcgcccctcccgagatagccaaggacgcaacttagcaccagcctggacgcctgctttcgaccctccggacaagaattacttcgcctgacattcccttggcataagcaccatg

SEQ ID NO: 7533 - DNA, 700 bp, Nannochloropsis_gaditana
caaggggagaatggaagcgcattccccgctttcacgtagtgacacaagacctttggggggggctcttcagggccatgtcgcgcaatttattggcatgtgcttcgtatgctccgacgagcggaagtccaggtgtcttttcaggtgttcagaaaccctatcccaaagccccgtgctcggtgtttgttctaggagtggaagggaataaaaagcgcggagacagaggcatggtctgcgtgttgggcgcgtgaagaagaccagcagttcccagcttactagacgtcgagcggattgaaacgagtaataaacataccaaggcttttttttgtccatttgatattcgaatatcctttttgtcacggcggacactggatcggaagaacagttgtgtgtgtcttggagcttcatgtaacagcgcttgcgagcaggtgatgattccttatctaatcctatttttttccatccttgtcgctcaaacgttgagaatcaattacatcaaggattctccttgattattcgtttcgtctgcatcgctttcgggtctcaaggggccatgatcttccgatatccaggatactttacctctgctcagctacctccccctcccctatcttgtgcccgccccacctcatcaagcaggccgatatcctggataactcagcaattctgatagtgtaaaactcggatataaaagtgaaggatg

SEQ ID NO: 7534 - DNA, 700 bp, Nannochloropsis_gaditana
gacacccccgccgttaaatttttccctctcgccccagcctcaacatcgatcttggacctcagttcttgaatcgaggtatcttcgggggggcgtggagagccatccaatgaaaggcgcgtgtcctcaattgtcacgatggtgtctcaggcatgcagaaacatgtgtgtagggttgaaatcttggtaactcggtgtccaaagacattgttctgccgaaagatatggggcagagggactgtcgccttcttgtgatgctcaggcactttctttgaccatcgtcggcgccataccccgcagatattttaagtcttgcaattcgatgtcaattatcagggtgatcccgtgccattagtggtgcgcatgattatgcacatttctattttcggagcaatgagggaggtacatgctggtgttgtcgctagacaggccagttggcacggagatcaagctttgccccgtctcttggcctactctcagaccctctgccctattttctgacaccagaaatcaagtccctaaaaaaatccacacatatcccttcacactcatacaattcatttaattttacaggtccgcattggtctagaccgaggtctgcctgtgttatcattccctcgaaacaagccctttcctagtcttcacctttcgagaagcgctctggaaagcgacacggcacaagcttttttcacgcaagtaccatg

SEQ ID NO: 7535 - DNA, 700 bp, Nannochloropsis_gaditana; identical to SEQ ID NO: 6173

SEQ ID NO: 7536 - DNA, 700 bp, Nannochloropsis_gaditana; identical to SEQ ID NO: 6174

SEQ ID NO: 7537 - DNA, 700 bp, Nannochloropsis_gaditana
attggcctttcgttggtgtgtaactctaaattaacgtatcttcccttcttgaattggggattttttttctgtgcttcctttcaaatgcgctgcggacccgaaaatgcagcatccaccagcctcctctttttagaaacatcttgcctgcgaactttgaattgcatggaaagtcattggcgctagaatgttacatttaaaccttatttcagttttcaatgcacgagtttttaggtgtcgtcgtgtgctgctgctgtccaaggcgtacattgttcatgaatgcgcatcttacgcggtattactcaaacaataatatcatcatattaatggtgtcggacaaatgttgcccttctcgccccctatcgaatgatcaggatggtgtcaaagagggggaaaacacgagtccgcaaaaagaaacggattttcaaatgtagcaacgggtgactataccagctgacgtctcccctgggcggaacacgggtgtcaagatgcacgaaacttgaccgagtgccattcggggtgacttcccagttttcggctgccaatgataaggtagaattatgaagatctacatatctctcgtgattatggacaagggattgtcattaaggaaaatgtggaacgtcgctcaagcctctcgcatgccttccttcctttatcccacgtgcctcaaatttccttcacaggcaaggtacacatcatg

SEQ ID NO: 7538 - DNA, 700 bp, Nannochloropsis_gaditana
agagcacaagttccttgcgccacaaagccaaacaaattccacaacctaggcgcaacgcttcaaagcaggtgtaaacaccatgggaacttttcgtcgctgggtggggaagtaggattatggaacacgacgtccaggggtttggttcgactaggggcccgatgacataatgtggaggccaatgctgtcgagaataaatcccagcgtggacggtaatggcttgtaagggacatggatagtgacaacacatctctgctttgaaatgaataacattctgctttaactggaggactggattaaagggcaagtctcgaccacaggcaaagggggggggcataaatcaaatttgcgggtgggcgggaagctcagaaggagaggtaacagaaggcagggaattgctactggatcccaagacgcaccgacatgtgtggatgtccaccagtgacatgttggtgctgacaaggcctttgaggggatgtgatttgcattctatccgatggtgttgacagcaagtcacaaatgttgtcacaaaaccaggcatcccctatcctacagctactggactgaagatcctagtctgctccagcggtacactggaatttcttctcccttaattatcaatattcaccacctttcattactaaataattctctactcacacttgtagacagagtctgcaggtctcacgggcctcaagaaatg

SEQ ID NO: 7539 - DNA, 700 bp, Nannochloropsis_gaditana
cggaattaaggcggagattggcagactctcgcaggtttggagaatgtagaggaacgcgtgatcaaaacataagattggacggattcactggaaacgatattttggtcaactgttgcgctcttgttttgctcgcacagagtgaggaggttgttcatgcggttatagtagtactcaacaccatccccttcacgcctaagatttttatcccactccgtataatgctcaagaaatacataatatgatttgatggatccccctcgaaagggcgcagtatgcgattgacagttcttggaaattaagacaaagaaagatcaacacgaatgtatgggccgaggaaataccgaaacttcttgtcagaccaagccacactttaccgcgttcacaatccttgtgccaggcacattttcttccctcatgaagacacttgatctgtcataatttgtgcctggaaatttgaaaagcactcgagttgtgaatgaaagaggagacggggaaaatatgcgcgaggttagatgttctacaaatattgtcgacttgaaggttgcgctgcgatacattcatatgttaaaggttcaacccccgtagctgcaaaatgaaaggcagaatgaggaacattataatgctcgtcatggcctcgtgtcaaataggggcaggcatacagagcctttatgggacttcccctttcgcagacgagaaaatg

SEQ ID NO: 7540 - DNA, 700 bp, Nannochloropsis_gaditana
gggtcaccccaacgaccacctcttcacccaagagggctggcgcggtttcctccactcttttctcaccttcgaaacctcctcccctttcactccctcctccttccgagccacgaacgcgcagagcccgaaagcaggcggttggatgagtgcattcctttccccagcccaacgtgtccttgcccgtctgatggggagggaaggaggggcgagggagggggaggaaggaaggacggccggggaggtggagaaagcgccgcggaagtcggcggtcacaggacaggtggactcgggcgtggccatcacgatcggcgcgacgcccaggatgcaggaaggggagcgaaagctgagcgctaccgcccgcacaccccggagcgtgaaaacaccgaagacgtcgggttcccagcggagcatgaaaacacccaggacgccgggttcccaccgggggaggaaacggttgacccgccaggcggtggcggagtcggtgaggaaggagatgcagggctttttcggattgttccagagggggggaagcaaggtggaggaggaagagaagaaggaagaggaagcgaggaggaagaagcggagggagaagaaggaggaggtgggggaggaaggggaggcgcggaagcggaaggaaaagaaagagaggaaggagagaaaaggtacgaaggagggaggagagggagcggaaggaggaatg

SEQ ID NO: 7541 - DNA, 700 bp, Nannochloropsis_gaditana
tttcccatccatttgtaaaccttaaacacctctttacggagtggatgcgaagggtgaagctgggagagggcaggacgaggtagtcgattcatcacagttgtcttcggggggtttcgggttcgtggcttgcgatgagctggagtgacgattgccgccaccacagggggagctttgaatgcaactgcccctccacctgattgaaaattgatcatgtcgacaccgatgcgtgtgtggggtcacctgatacaggcagggcaactttgcaatgccaacttacgccttgtacggcacggcgaccggcacggtggctggaaaactcgtgtatcggtcggcgtctaactacggacatatcgaggaaatacctgccatgccgtggtcctgtgattcacccctgtttacgaagtaatgattcgaagtagggaatgtcagcttgtcaatttgacctacattgccgtgtggggacaccagaagccgtgtgttcctgtttcgcgtctttttcgccatgtcgctggcttcgcttaagctgccgtctcggttgcgccctacacacgtcacactttttcaacccatctaccgttttttagctgcctcccccccaaaaaaactttctcagggactcaatgcatgttataacggacacgaacagggccctttcatttatggctacagctccatcttggcgctcagggactttgccatg

SEQ ID NO: 7542 - DNA, 700 bp, Nannochloropsis_gaditana
cctgaccaccccggaaataaaaacgtgaagcggcgcaactggagcatttttgctataatgtgtttgaactcacatcttctcgccgttgaggcaagccttcgagcccacggtcgtcgctttcgggccccggcagcagtggaagacgaatccttgctgccctcctcgccggcggacagcgcttgctcctctttggaatgcttggatgatttcgatacaaatatcatcgggagtagtggccgttactatgcgggaggagaggcctctgtgacttcagagggagtggtagatgagcgtgcgtaaatgacctcctatcccaacctgtgcgacctgccctcgacgggtcgttgaggagtcgagagccgtcctctgcacctatctcacttttgtccagactccatcgcgaacgattgtgacgcagcgatacaatcatgtgtctcctacgagcctcttggacttgtctcatctttcgtatcgcatggtgccgtaccgtctcgttccctcaagtcaccctagtctgttcacgagatccattaggtcgcccgtatggccgcagccattttttctcttgatcgagtttactttgcgcaaataggggctttatcgatgtcaatgcaacgtgcacggcctcacgtacccatctccgcccccaccttcccacatgtcacacagcctacttcctctcttcatacagagcaccatg

SEQ ID NO: 7543 - DNA, 309 bp, Nannochloropsis_gaditana
ctgccatcctacagactaatgccaaagtgccaagatcaacgtacagcacgcccccgttgacaatgccctggaggccgccgcactccgcgcagccaaccagatcgccttcctagtccgagcctaccgggccgagcaggcggagttcttgaggtggggggaggggaaaaggggggattcctttcaatggcctgattaaggggttcttggttggtctccacgcccgcctccccttcactctcccctcccttctctttcggcgcctgcctgccccttctcccatccttgcccaggaaccacgacgaggccatg

SEQ ID NO: 7544 - DNA, 700 bp, Nannochloropsis_gaditana; identical to SEQ ID NO: 5404

SEQ ID NO: 7545 - DNA, 700 bp, Nannochloropsis_gaditana
ttgaacgattgaaccctgccaaacacacgctggctttatgggaggaatgacgtgggagtagaaagccagttactgactgatcgatcacaaagataagtcatttgtctttacattctcctttgcttatgaagccctactcgattacaaatacatcgcaggtgccctcatgagaccgacaacccgtctcttcattccgtttctgctttcacttgtctcgctgccaagcacgatatcatttattggtcgtactgcctgttcttcgaagtcgcagcgagccctgcggagaagagagggctctcccaaggccgtcgctttcaagcctcagaagggtctcgcgcatgacttttgcctcgcaattttaggggatcttcacttggacccgacagacatgaagcttcataatgaaggacgcaagcatatcatagatgttatgggggggatgaaaaagtcgctttcctcgagcaagtcgcaagctcacctcatcagtctcggggacctaggcgcatacggcgaggcaggcaccacggcttgcttcgagcacgcaaaagcttaccttgacggctttcaattgccttacaacctcgtcactgggtaagaaatcttcttcggtgcatttttaaatattgagggcaacgccactcacaggcgcctcgcattccacttcttttcccgcctcaggaatcatgatttggagggcatg

SEQ ID NO: 7546 - DNA, 700 bp, Nannochloropsis_gaditana
agcgaatgaattgcggtacccaaatgcttctcgtttgcgtaaattgttttacctcagtgcctgtgaagggaggggcgcgaacatctcaacctccccgctccttcccgggggcacaccttgtcgggcagctcccgtgcgcattcatgtcacaccaacatgatacgtttggcgtagcgaacaaaggcactggcagatggcatcatgtcaataaggattgaattgctattcgttaaaaaaatgttatcatggctcagattctgttactattggcccaccgactctttaatgcacccacagatgcggggccgcctccccgacctggggctcacttggctatgaaaaaggacttatcaacatggagaccgtgaaatcaacctccgtgcaaagtcatgcgagcgcagccctgacctccgatttcgatgcagcttttgcattccaagttgacgctgacgacgacacctcacttcctgacgttacttgcagaaatcacgccaatgaaaaactcccaaccccttttgaattatggaagtacatttatgcaagcattttattcggtaatcctctcctacgggacttggtatggattaatcttgctgtacacgtcacattctggcttctcttctcaacccttctgtgggcagtattcttgggatacctgccattttctataactttcaaggcatatttcttcggatctatg

SEQ ID NO: 7547 - DNA, 700 bp, Nannochloropsis_gaditana
tccagcaggttggcctggtggatgtgcgcacactccaggtctttgatgctgagttcagaggaaagtttcgagtctttgaccgacttgtatttgattactttggccccggagggggcctgaccgccttcctctgatgaggcaggaggtggatgcaacatgtcggggccgcggaaaaatgcgacttttttgtgcttccggctgtaaagggccagcgtcgttgcagtggcagccgagataaaaaataacgacgctgcgatgggcggatgagtttccattttggcctcggacgaaaattaagtttggtgtcgggggctaaatgaatccaggcggactcaccagaagccgaagggaagcgaggagacgcttttcctgtgcagattgcgtcgaggaaataaactttgaacaaccaaccacgcatctaagcaacaacatgcatcaatcgaagcggttggctgaccggtcttgcgaacggaggtgaagtttcgttctgaatgaatgattactagtggagcaacatgcacactaaagcctgcttaagcgagcgcagcagtatccgcgttcgctcaagaagcgatagctatgaaatagcatggcccacacacaagccgccaaactggggtactcacatccacctctatctccaagaaaaattgccgctgtctcatgcattcccctttttaggcatcttcatatttgcatg

SEQ ID NO: 7548 - DNA, 700 bp, Nannochloropsis_gaditana
  misc_feature (1)..(163): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccccagtaagtgaggcatcatccgcttcccgtgcaagcgagtatagaattatttccagacgtcctgagcacgcatttgccaacgcttttacttctctttgacctatcccttgatggtcttttggatcgactatattccgacttgcatatttgacatagcatgggtattctttgtgtcaacctcccgaatgaaaagaattcgaggccagtggaaaaaatgtgtgtccattgttgtccatcatcaagagcatgtggtgtgatcctttagttcgcagtaaacgatttgttcatgcactctcagaaaggcgggctccgcattaacctcctccctcaggaaatatgctagaaaataaacgttcctcacgagaagactccctctcaatatcagattttttgcccgaagttgcgcaatgctttaaaaggagccctcacgttatttcggaaagcttgctttttgggaggatggactgactaaaatcacaccgccttacatacaggtattctcactgcgtcgtgactcttcgaaagaatg

SEQ ID NO: 7549 - DNA, 700 bp, Nannochloropsis_gaditana; identical to SEQ ID NO: 4719

SEQ ID NO: 7550 - DNA, 700 bp, Nannochloropsis_gaditana
gggcgtgtggccccccctcgccgcaaaacgtcaagaaaaagtttgaatcactcctcgccctttttcctcaaaacgactttcttggacttcggcgccatgaaaccccaccgatgcactgcaaactagacgaacaacgaaatgtcctcagcatctgcacgacttcggtgcacgcggggtttttccatcaccctgtgtggtgctttggaaaggggcggtcggaaagggcttatttgtctctcgcttcctctcgctttttccccatatatccagtaaatactttggatggccaagatccccgaagatactattgcgcgaggccctttgacatcatgtgcacattctgctgctgatttctcttccttcgtcatcaatccacccgatttttcttgatcttctggtttgtgcatccaactatggtcacagcatttattcgccacacacagctttttggatcaggtgggacattcggccccctgtatctcggctacgcctccagccctgaaccgcctgcttccacgcagcaatcgcttcacgtcaagttgatatcaggatgctcacattcctcatcgcccggtgacattccttcctagttgaggaactccctccattctgctagtcatctgtttttcttgaagattttatacattcagaggaccctttcaggtccgaggaggtccggcagtggctctgggagaccatg

SEQ ID NO: 7551 - DNA, 700 bp, Nannochloropsis_gaditana; identical to SEQ ID NO: 5926

SEQ ID NO: 7552 - DNA, 700 bp, Nannochloropsis_gaditana
cagatttcgacataccggcggcactttttagcaaatcgagcatggatttacaggcagcatgctcacattcctcttccacggccgctaaagggttgtcaattcgaggtggcggagtaggggggggcatggctgagctggacgttagggcctgcagcaatactattttcacctgtttagaacctagaaactggaggaaaacagaaaattttaagatggagagaaaattcgccatggttggacgcctgctttcaaaggaaagtggcacccgaagcggagggccgaagggggcgagtctccctgctcgcccgttcccagagaggaatgaggcattgccactccttgtctttgaccacatacttaaatataaactcgacccgaccctatttcaatggaatgactgatttgttgagaaccatacggttgcattgttatcgtggcgtgggataggcctgcgagtggctttgaacgcaagcagaccctttttcctctccgagtggacggctgcagcaacttgccttcggactgcaacttgcctccttttgtgcccttggttattcccgtccacgttctatcatcgcgtacgaatttatagaaacaggacaagggcttactcaaaagctgtcatttaacagggtacgctttggagtcggtggtaagcatttgggcgctgaagtgctcaagatacacagcgtggagaatg

SEQ ID NO: 7553 - DNA, 172 bp, Nannochloropsis_gaditana
gggggccgggggaggaactttgagcgaggaggaacagaaggaattggacgtgtggttgggaatgatttcgagtgggagagggacctccgcctcctccagtccttctgcactgtctctcttcaaaggccctgcctcgctcccctcctcctcgttcactccctcgccgggaatg

SEQ ID NO: 7554 - DNA, 700 bp, Nannochloropsis_gaditana
aggaagtgcacgtcagaaatagtaaagtacgccgacgacgacagtcaggaccatgtcctcttcaaactgaagacgtgcgtccggctttatgccatctacctagtgcatgcatacacagacatgacatttgacagaaaacactggcgaaaaggcgcggacagcgggggggaaacaacgaaccggtagtttgagggcctgtgcaacctccgaagccactcgcatgactaaagcctcatcccgaagcgtggcctcctgcgcagccttgaccctgccagcatctatgtctgtcatcacgggccgcaccctacccagcttgggcagatgccgccaagctgaccctgtaaagcgctcgagctgaagcagaaggagggggaggtgagggcggacactgcatttgacggcctgcgtctccctacattcatgcgcgccactgagcgagagcacacgtgaacgcatgagagaggcaagttaattctcattttaaggatttttgtggttacagaacctatcgattcgttcacatgaaggacgaaggacgaaggcaacgtccaggaaggggagagggggacagggaggcccaaccacccctcaccgccgccccggctttcaggggaatttcccggttcgatttgacacctcaaacggccaaaaacgactggataggacaatcttatacatcaactctcacaggtcatcaatg

SEQ ID NO: 7555 - DNA, 274 bp, Nannochloropsis_gaditana
gcgcgagcccatattgacatcacgcggaggaaggaggaggggcggatggcttggaaggtcgtttgcgggccctctttcggcgagcagaagacgccacgctcagtattcgtggggatcggggggaggtatgtctttctgactgtttcggaggagttggcgcctgcgatgtctagctccttcctcctcgctctcctctcccctccatcagcttcttccctccttgttttccgtctgaaatgcttccttgtctctccctcccctccgccagtcggct

SEQ ID NO: 7556 - DNA, 700 bp, Nannochloropsis_gaditana; identical to SEQ ID NO: 6419

SEQ ID NO: 7557 - DNA, 700 bp, Nannochloropsis_gaditana
tggctgtcgtcttgacaagaagacagcgggttgctccacctcgaccccctgggaggcgggagccagtgggagcgggcagctcagtacatctccctcctcactcgaaagcgacgcgcaaagcctttcaagcaccaaccgtgggaccagccccggtctggcgtcctccaggggcggcggcaacagcagcatccccaccagcagtctgccgcacagtttgacagtgcaggagctgaaagagctgacacgaatgcgcctggctcgcgaagcggggatcgtcaccctcccgggcaccatggagggagggccggacacgcgtctctcccctgaggaaggccgttctcagtatgccccaaagcatgggcaaggcccgcggacaatgcggcagccgacgcacccacaccggtgtcgagggccctcgccatccacctcgtcgaccccagcctcgcctatgaactcgcccatggtctctcgaccccccagcccccagctctatccgatgaagggccagtcgtcggagagctccacagaggagacggccacccagtcttctctcccgacctccgccgttgctccctccccgattccctgtggtggggcgcccctctcctcctcctgcccggctagctcgccctccttctcttttccgggtgtcccggaatgtgcgaacccccctggcacccgcgactcggtccccaatatg

SEQ ID NO: 7558 - DNA, 700 bp, Nannochloropsis_gaditana
ttgtcctccacttcgcctcctgccgccttcacgccgtttgttaagcctttgcgtttcgcatcagctttggctggggtgagacccggcgcggcaatgggggctacagtctccgccacgtcctccccgtcaaaggccccaaagaggtcgttcagctcgccaccatccatcgaaagcgaagatattgctccgtggggctggatgatgggcatggcaggagagggatgagaggcatgagacaaggagcaacacatagggttcaagtatgggaggcttcgggtactcaagatttcaacgcgggccttgagggtcccgtgagaaatatcgaatgcatgtccaacatttcgcagcgcatgctgaagggagtgaatgaattgcatgacaggcttcgcaagacccagaaaaggacgtaagggctagggagataaaaagggatggcggggcggctcgatacgaggaagaaagtagccagcgagagacctgactacctccccgaaaagggaaaaaagagaaggcagtgcattacatgttcatccctgccgtccaatgtaccatgcgggccttctaaactcgatagattccatgcgtgcatggcgagggctgccattttggcttactgctatttttccctgtttgtccacaggagtcatcccagtgcttagtcactccggcgcctgaaggcagcaagaggcgccaaagcatg

SEQ ID NO: 7559 - DNA, 700 bp, Nannochloropsis_gaditana
ttgctacatgtttggacaacgaagcgatgctcagagaggccttggctgccgctttgcccagtgacggccagtgtgcccgtacctttcttccagtctctagtctgatgtctgaatgccaagagggctcgaaaaggcaggatagcttgttcctccgggtccaggttattgctttggatctggaaaagttgaggacagaggcctgggtgcacagtgtaccagacggaggcatgtagctgtaggagtacatacacaagtatcgatttaaagcatgaccacacgtaacataaaactgcgcagacaaatgaatcacacactgccctggtcggcaatgtagccaccgtgaccagcggaacgccaaacatcgcccggggtccgacctcccccggcccatttgccttgtgatgctttacgacccctcgattgctcccttgctctgtggcctccactctccctaccaggacctcgcgcagtctctggcttcgggacttgcagcgtcctgcgtggaaccctcaatgcctgctgatgccttggcaggttgcaatacgtgccttgtctcgctttttcctcaagctcctgcccgtctggtggtctacgaactgatgcctctcctctgtccaacctccattcactccctctcctaaacgcggccctttcttccttccagccgaagccgtacgggaaaagcacgtgaataagcatg

SEQ ID NO: 7560 - DNA, 700 bp, Nannochloropsis_gaditana
tctctagtaggataaataatggcagcaacaatcgcaaacggagcagcgtggaggcggagtatcgggacctggatttccaagtgtagttggtagctcgctttgggggagacgatgctgagaacgcagataagggaaacaatgaggaaggtgacggctgctgtgggtgtggcaaagggtctcctcctcttgacatctattgcgtgagtggtgaaagaggaaataagtgctcgcgtacgaaaaaagaggatggcgggcagtactgcagggcgccaggtgcagtatcttgagttgctctgcaggcgagaaggttgcctacgctctttccgagtacattgtccctatttgctcaccaactattaatatatcgatcaactaaataaaactcacacacagacaagtgctggagatacctctcctcataaattcccaaaattccaatcggggagagccgtccgctattgttgtttaacctccccaccctagaatgcggtttgttgcattagttagcggcggtaaggacagcgttttcagcattgcaaaatgcctggcttacggacatgagctcgttgttttagcaaatttgtttcctccagtcgatggaccagaggaattggactctttcatgtttcaaagcgcggggtcgtctgccgtcgagtgccttgctgaatgtataggcgtgcccatggtaagagctaccatg

SEQ ID NO: 7561 - DNA, 22 bp, Nannochloropsis_gaditana
ccgcatgagcaaatcggcgatg

SEQ ID NO: 7562 - DNA, 700 bp, Nannochloropsis_gaditana
gatgtctggtcatctcgcaccttaatgcccttgtccttctcttgctcctccttcgttgtgaacggtggagcggtggagggcttcaactgcattgtgattccacctcttctttgcagagtgatacgagtgcgcccgcagacaagcttgcccgccccaatgccatgagatactcccgcagcctcgatccgccctctacggccttggcccggaggcttgcaccgcccgcgcgccaaaaaggcatgtgttgtcgcggtagacgcaacggcagctaaaaatatgctgaggatcagatgccgtggcatggctcgttacctgtatgtaggtattaaggcgtgcgaataagtcgacatcaagaggtagttgcagtgcgagcttcctcctccgagtcgagtctgcccgccgggaggtcgagcacgcctccgcaggtggggttggatcctacgaggaagacttagtggtctggcgaattgaatattcagaggtccttttgtttcgaaaaattcacaaaagaagtattatggacctccgtcaaggtctgtcacaacttctatggatccagtctgatgattctcttcgcgcctcgagcccgagcaggactgaatgcaagcttttctcttagcagcatcgagtttcccattgtttgatcggtttatcccgacacgcaacacagtgtagggtaggcggcacctagccagccatg

SEQ ID NO: 7563 - DNA, 700 bp, Nannochloropsis_gaditana; identical to SEQ ID NO: 4738

SEQ ID NO: 7564 - DNA, 700 bp, Nannochloropsis_gaditana
gctctttccccgcgtaaactcacgagcagtcgaggccaggatccgcgttgtgtgcacgccgcggcgggcggccagttgaaagattcctcgtgcaacaagcatgggtcgacgctgttttgtgagatgattcgaaattgagaaggcatgagaaatgctgcggtgagaattggaaaatcgaagatgacggagcgacgggcagcaagagtacgacatacgtcgggcaatgggataccgaacgtgaacgcttgtgtgggcgaatgtctgcttccccacgacatggaacaaaatataggctgctctcttcatctccttgcaggccggtgtcgacgtacgaaagggcgcccacaaagcggacaacaacctcgggcacaagctctctccctttgccctctctcgcctcgcccttcgcaggctcgaggaggccctgagagggaggtgcctattccatcatatcagctaccgtggcccttcgactcgagtctcgagggcttcgaggggtaccttttccatcatatcatcccgaccaagggacctttcccctcacatcatggtgctttagtatgcttgacctcccgactacaagcccgtgcagttcacactcatgcaacatttcacgacgcaatacgtcatccatgacaagacagaaagtttgtgggttcaagaaatagggtgcgctttatccctgctattttcgcaaatg

SEQ ID NO: 7565 - DNA, 700 bp, Nannochloropsis_gaditana
tgcgctcttgtcctatccgcgcgaggacacgcggcctagcttgactttggaagacggcagcacaaagtcgacgctttttgccgccactttgtcggagccatttcttcccgaggactctacttctgacacatggcttcgtaatcatacctttctggggtatgcgcctagtggggaagtgaaagcccccttggtttacgcaaattttggtcggcccgaagacttcgaggtgctagccgaggcgggcgtgatcgtggaaggaagcattgtcctgatgcggtacggcgaatgcttccgggggctcaaggtcatgaacgccgagaaacgaggcgccgtgggggccttgatctattccgaccccgaacaagacggctacgccctcggacccacctacccggagggaccctggcgccccgccttcggcgtccagcgaggctcggtgcaattcctctccctctgtgccggggatcccggtcgcaccgccttggcagaggatgggggaagcgcggaggacgtgtgcgggtatgccactgaggacttgaagccgaaaatccccgtcctgcccatctcttacggggacgccacgccattcttgcagagcctggcaaacgcaggcgcggagagccccgtggctcctgcctcctttcaaggagcgctaaaccttacctaccacctgggtccttcccgggatagggtcgtcatg

SEQ ID NO: 7566 - DNA, 700 bp, Nannochloropsis_gaditana
gtcactcttcacatcatagtctcatcccactgccatctcctcctttccctggcacatttttcaaaatctcagacgcaaccatgggagagacccgggcatgggccaagtacccatgctatagtggactcctcctcctcgtgctccttctcgatactctttcgtcggccaccgcggacaaggaataccaagctcgcttgcgtaggccagcctccaatcttcctagctcgtaccccgaagatcctgaagatattttcgtgcaggcgctgagtgcccagtctgcgagggcgtctctccactacttgacgtcaattccacacatggctggaacgccaggagatctgaagatggcccaatacgttcaagcgcaatggcaatccttcggtattgaagccgaaattcagccggttcctgcgctcttgtcctatccgcgcgaggacacgcggcctagcttgactttggaagacggcagcacaaagtcgacgctttttgccgccactttgtcggagccatttcttcccgaggactctacttctgacacatggcttcgtaatcatacctttctggggtatgcgcctagtggggaagtgaaagcccccttggtttacgcaaattttggtcggcccgaagacttcgaggtgctagccgaggcgggcgtgatcgtggaaggaagcattgtcctgatgcggtacggcgaatgctt

SEQ ID NO: 7567 - DNA, 700 bp, Nannochloropsis_gaditana
gtccacgccctcaccacaaccgccagacccaaactcggacggcatacggagtgatggagccgaccttccacttccccgcacgtcgtgaaatggaagggcggcggccgtccaggagaagaatcggtcgtggcccgtcgcctcgagacgctgtcgtcgggaactttgatcgataaggccccccccctggccgaaatgaagtcacgctgtgtgctcgacaacggacgaacgaaccacgcatttttccttccctacgtgcgaggaaacatcatgtcactcttcacatcatagtctcatcccactgccatctcctcctttccctggcacatttttcaaaatctcagacgcaaccatgggagagacccgggcatgggccaagtacccatgctatagtggactcctcctcctcgtgctccttctcgatactctttcgtcggccaccgcggacaaggaataccaagctcgcttgcgtaggccagcctccaatcttcctagctcgtaccccgaagatcctgaagatattttcgtgcaggcgctgagtgcccagtctgcgagggcgtctctccactacttgacgtcaattccacacatggctggaacgccaggagatctgaagatggcccaatacgttcaagcgcaatggcaatccttcggtattgaagccgaaattcagccggttcctgcgctcttgtcctatccgcgc

SEQ ID NO: 7568 - DNA, 700 bp, Nannochloropsis_gaditana
tcctcgatccttggacaccgtcccgtttgtccaagacctgtgacgtggtgagaatgtgccggtgcgtcaggttatatgcagagggtgggccttgtcctcttgcaggcttcgttcgccgcttgggacttcttcaagcgagtgacgacgcgtagagacggtcggttggcctgccgggtcacgcgaagtccacgccctcaccacaaccgccagacccaaactcggacggcatacggagtgatggagccgaccttccacttccccgcacgtcgtgaaatggaagggcggcggccgtccaggagaagaatcggtcgtggcccgtcgcctcgagacgctgtcgtcgggaactttgatcgataaggccccccccctggccgaaatgaagtcacgctgtgtgctcgacaacggacgaacgaaccacgcatttttccttccctacgtgcgaggaaacatcatgtcactcttcacatcatagtctcatcccactgccatctcctcctttccctggcacatttttcaaaatctcagacgcaaccatgggagagacccgggcatgggccaagtacccatgctatagtggactcctcctcctcgtgctccttctcgatactctttcgtcggccaccgcggacaaggaataccaagctcgcttgcgtaggccagcctccaatcttcctagctcgtaccccgaagatcctgaaga

SEQ ID NO: 7569 - DNA, 700 bp, Nannochloropsis_gaditana
taagagccgccaggtccgtcatgtggcagtcccaatcgtgctcctccccgtcctcctcctcgtccgtctcacagacattttcaccatccacgtgcaccaaaccatcggcatccgcatggggactggcggaggtagaatcatggtggtggccattgccgtttccttccccccctgcgactgcagcccccaactcctcctcgctgcccacatcgatgatgcgtagcggaggcccaagcgagatatgaaggaagccaatgtccaaagtgaggaacgcaagatcatgcaaatcacgttacaccgaatttgtctcacctgaggactgagaaactgtgctccactgccctcccggccgtgtccgtgggagggacgggcgggccctccgcttgcgccgactgagtggccgaataagccggagggggggggcaagggggctcaaaggacggcggtaaacagcagcagaagaccatactatccaacagtcctcgcctgtgcctggcgcgggttcggggagaggagatcctattagcactgagagcaagatgagcgagaggggggcctcgctcacacgcttgccagtcccgtttcttcgaccatataaacgggaaggggcagctcgtttcagacgtgctctacggcagatatacaagcacgtgtacatggctttaaactatctctttaattacgacgattcatgtacagg

SEQ ID NO: 7570 - DNA, 700 bp, Nannochloropsis_gaditana
gagcgtccccacctcgcgaataagccagactgtttagaccacagtgctacgcatccatttctgccatcatcaaccaagaaaaccgtcacttgcaggcgcgagggtgccagcgacggtcatgatgatagtaatgtttagaaagcaaggggtggaaatccgcatttctatgcgcacccgcgcaacaccggtgactccatccggaggtcgttgaactggaccatcgcaagattttcttcctccttgagggcagcggtcccgtgttgcgccaagaaatagcggcgagtccagcggcgagccgcagatgcgcggtatgggggtgggccgaagtgggaggtaattacggtctgagggccctccgtcgccgccctggccgcctccccgttcgcgtgtggtggtaaagcactggcgagccgcaccccgcgcatggtaatggtagcacgggttttgaggatggtagacggggcggtggcagtttggttgtgaggctgttgtcgtccaggggcccgctccttattttccttttcctgtgtggcaacggacggctgtcgagcatcgcgtgcaccgccctccacgggcaagctaggccttcccttttttctctcttattgtcgtcacggtgatcaacgacatgtggcatcaaatgtgaactgagtgcaatgcaggatggcatgactgtcgtcctgctggaatagcgacaatg

SEQ ID NO: 7571 - DNA, 700 bp, Nannochloropsis_gaditana; identical to SEQ ID NO: 5808

SEQ ID NO: 7572 - DNA, 700 bp, Nannochloropsis_gaditana
atttagacagtcctgaaagtggggctcatcgcgtgcgtggaggaagcgatttcgtgtctgcgtgaacttggtttgcttggaccaaaatgaggacaagatgagcgtagagaagcgcgctagcctgttgtgtggtgacaatcgcatggaacggtaagccctgagaagagtaattgcgacgagttacagcccgtgctggcaggtagtcggacacgtcctgactgagcatggatctggccttgacgatccgatctgccacttagaaaacccgcgaggaggagaaagcatcggggcccttcaatgacacgcttggactgaagataagaggctatccataacgatgagtgagcgtttgtcattttttgttgtattaggaggtcgtgtgttggaaatttggggctatgtcctgtgctctcgtgtaacttgccttacctcctcgtacccgtccccatcggaaaaagaagaaaagccgcaagcgtgttcttttctagtctttgcacgtgcacgatgtctctttcacataaaataatcgatggctacacaaccggatcattgtaccacagggccagggtgtgtatacccgcttgaacggaagagcggtcatcattacggtttcagtatcttttcgcttggtcagggccttgagatcttcaagtggggtggcccacacatctggaccgcaggcacaggaaaaattaaaatg

SEQ ID NO: 7573 - DNA, 700 bp, Nannochloropsis_gaditana
  misc_feature (1)..(667): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcggggccagggcggggcgcgacgggaaggga

SEQ ID NO: 7574 - DNA, 187 bp, Nannochloropsis_gaditana
agatgattagcaaggcggggatgtgcagctggtgttggagccctgcacgggctccatgagcctggcggtctgcgacggctcgtgcgtcggcctctacccgaccgagcacgactatcggtacctggcagactccacacagacgtgtactcgagagggatgccgcccgttgcccggggctcaggccatg

SEQ ID NO: 7575 - DNA, 198 bp, Nannochloropsis_gaditana
catttttcgaagagcgtggacgttcttcgcgagaaaatcagagaggaagaagcacaggtgaaggcgagcgagggagggagggagcgaacgagggagggaaggagggagggcaggcaaggagcgtctcacgtgcctgctcgttctcctttctttctttcccattctccccagaacgcggccctggagaaggaagtgatg

SEQ ID NO: 7576 - DNA, 700 bp, Nannochloropsis_gaditana; identical to SEQ ID NO: 5275

SEQ ID NO: 7577 - DNA, 700 bp, Nannochloropsis_gaditana
gcctctgtgggcactccgcccgtatgccattctcacctcggcgcaaccaacaatatcgcctctccgagagagagcgcgatgagaggagcccctcttgacacagctcgagcagcagcatcactttgaggcaattgacccttggcatcaaagcgtgttagaggactgatagggctgaagctttcggcgaaagttccagatgaccatattaagttgacgaggacaaggaggaggaccttggggaggttaatcgaggtgccgtagatctcgagcctcgtgagcatccccgacgccggcgtcagaacttccgaagaggttgctatcgttgtcatatttgtgtgcagaggaattcaataccacatgtgaagcgaaggatcaaggaaaagtcggacagactttgaaaaaagggaggcaacggacagcgagagctcccgtgggagccgtgggagccgacctggcgagctgaggcgagcacttcttaagcacccaaatacactagtaccctccagaactacacggcgtcacgagcttttcatcgtttcgcgcgtattcttacagaattttttatatctacatggagactgacgtcttcctcggataggaagtccgggcagtcacatgaagtcactgatcttcagtttttacgcgctgccatctccataattccaggggggcagccttcccgtcggtcgttgaattcatg

SEQ ID NO: 7578 - DNA, 700 bp, Nannochloropsis_gaditana; identical to SEQ ID NO: 5278

SEQ ID NO: 7579 - DNA, 700 bp, Nannochloropsis_gaditana; identical to SEQ ID NO: 4437

SEQ ID NO: 7580 - DNA, 700 bp, Nannochloropsis_gaditana; identical to SEQ ID NO: 4439

SEQ ID NO: 7581 - DNA, 700 bp, Nannochloropsis_gaditana
actttaattcgttcacttatttcttatatcccagagaaataatttgagtgttcacagacaattttcctgtccatctcgacctttctgggattttaggagggaagtcctatttgtaagccgcttggaattgttgaagactcatctcgggtatgatttaccgatgggagtacttatttcacttatgttttcgtaatgaaactcaaagctgacgtcaaagagatcctctgctcctagcaggaaaaaaatggatgcaaataaggtcacaaagacggctaatagatcgacttttgtacgacatagactcaacattgtgccgtctcatccggggtctggaaagccagtattacgcgtcataccagcatggagctttgagcttttgataagtatgaagttcacgcagtgattgccttgccagaaaaaggtgtctacgcaaatgatcgcccggttgggcgaagtgtttttccgactgccgcgcccgtgtatgcgtctcgtcaggcatcagaaggtcctggaggcccattgcgccctgcactttacggtgcggtcatccctttgtcgtttcaacgtggttttcgcaacctgccttgtaaacatgcgctcccatttttccacctcggaacagacaagatgtctggcctcagttatcgagggcgtacgaaaagaatatggaaatcgttccctggtccgacttggagacatg

SEQ ID NO: 7582 - DNA, 700 bp, Nannochloropsis_gaditana
cttgtccatgaaggggcgatgtatgacgttaagtgtgcgtgttcaagcggggtaaagtgtaaaaatcgcttggccgatccccttagatcaattgatacctactacactgagatcctcctatcctcagaaagcagcgccgggcccgcacaaaacctaagagtcctattcgtcacgatgtaagatgaaaagagcgtgaaaaacggtacaaagctgctgtcagtcgatatttttttattttgcttatcggctcgtcacccttgctcgtcaacgagagtcttgacgttttgcgatgcatgtacatacaaagcaaatgacagcccaacaaatcccattttatgttttataaacaaacgaaaaggttgcaatatgcacttggatttcctgcaattggggcaaggcgtaatagtcgctccttgattttggaataaaacttacacctgacgtgtagactctcgctgctgttccttcaccctcctgcttgaaaaacctttttcttcctaattactgtttctcaccgcacgccaagcccgattcaccctctaatcaatgagtaaatcctctgcacatggtattcgtgcctatggatagcctatttcacaaacggggtttacatcgcatacactttccacacgctctaacacgacttctcattcccttcctcgaacgcagacagggactcttttgttttaataggagcatg

SEQ ID NO: 7583 - DNA, 700 bp, Nannochloropsis_gaditana
  misc_feature (146)..(677): n is a, c, g, or t
aacttcccgaggcgccctacgacttctacatcatggcaagtgtcgacgattgcatccagtcagcccgtcgggaacacctattggactcaacaacacctcaattcgctatctcttgtaaacacgccgggacagacgaggaagctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggctccttcgtgggtgcggatg

SEQ ID NO: 7584 - DNA, 700 bp, Nannochloropsis_gaditana
atgcataccagggcgccgcacgacaacgagaagaatccgccgcacatcacaggtcggagtcgccagagaccgtcgccaaaaacctcaacatagacgaaaggcaaaagctcacacctgccgactctgcacgtatgcagcagatcatgccacgccggacagcattcataggtacaagcgtcccaaagccagtcaccgtgatgaaaagggggagaaatagcaagggcatcgcctctcttataggcaagtaccccggcgctctggcgatgggccttctttcccttgctttttgttggattgtttccttctggcggccgctgagctccgagcaatttgccagacaatggtgagttggcgtcaatcaggagggctgatatgtgaaatgaaatggaaactgtactcacagcccaagcacatataacttcttttttgttttcttcgcaacccttccacaattttaatatcgtcaggtttgagaacggtggttttttgcctcagtgcaaccaggctttaacatttgccaaagctgcctcagaactccgttgttatgcaaagaacattttggcggatggaagtgtgaatcgaggtgagggcaattactatgaaaggacataatttgaacgggaaagagatgtaacttttttttttctccaaacagggctgttcggatttaatagtaaaaattctagccacataagtgatg

SEQ ID NO: 7585 - DNA, 700 bp, Nannochloropsis_gaditana
gagaaatacaacacagttaaaaccatgacaacaccttcttccccaagtctatacccccctgggcgcatcccgccgggtggtacctcggctcgactcggcctggcattaccctaagtgcgctattctgtgtacacatcgagaaatgtaaggcattcactcatggcccaatacgacattgttagcaggggaggatatgcgggggcgaggagaggacggggcggattcaggaccccaaaatagatggggataaaaggagaagggtgcaagtgtagggcgtaggcgtggtacgagggcaatcagggggtgctaggagacgcggcgtgaccatgcagcgcttttggcacaacgatggccttaccatagtggagccgagggctagtattacgatgtttggccgcattctattcgtcagacatctgtctttatttctttgcacatggttgagcttcgttctcaagtcctgcttcgagacgtcgtcatacgcatacacggggcagctgaggggccttgcatgtcctttgtgaccttttaacagtactcctaaaacaatgccaaaaagcatgcagtgactttgttaatgttgtttttggagcagtggtgcttctctatggcgtgataacgacatcctcttgtcgccatcgtttctcacgcaaacctccttcctcagctcttgggacaggccttgacacttgaaagtatg

SEQ ID NO: 7586 - DNA, 700 bp, Nannochloropsis_gaditana
  misc_feature (166)..(175): n is a, c, g, or t
cccatccctctcgttcgctattccggtcttgccccgcgcatccttccacccctcccttccctctttctcccccagtttttctctcgcttaccgctcgcccccgctcctttgttgacggcggccgccagggccgggaacttgagagcaccgatgccatgtgcacagnnnnnnnnnnccccccccctcccaccttttcttattataaacatgttctcaaagcataaactcttccctatctttctccccaacactctgtttcacctcaaggccggcaaaaaatccgcagtggatagtcattcaatctcgactctgcctgtttccgcacctcgtggatccctaccttcccagactagtctccttccgtcacccaaaagattagtagacgcccggcagctaccgccttcggttattcatcaaaatctagcaaccgatttctccgttcccaggaccctttctgccgcactgtggatgtttttcacccatccatcaatccttcttatactatgtggcctcgcagggcttgtggcgggccgattttctttcagcggtccttcctcctcccttttgcagatttttctcgagtgctctctagtcctgctcacaattgtaggctggattctgcaggagtggttcctccaccgttttctcctccacagttcctttgactggtttggtagggagatccacgcacagcatcatg

SEQ ID NO: 7587 - DNA, 700 bp, Nannochloropsis_gaditana
tgtccaagtcgttggtgccttggaaatgagtggctaaagcctgccctacagcccgctctgacgctcctgcatgaccataattaggcgccgtatcaaaaactcgtattccatgccgtatggcggcggtcaaggctttcagatgaggcagacttggagtgattcgcgcgcagccaaagccgatgcggcggatgcctgtccggggcgacatgccgaattttttcagtgcggattggtaatgtacacagacacgttgtccgaacgcggaagaagctcgacgacaacggtactccaatgctactttttctatctatgcgtgaggtgaagaaagtgaagccgttgcgctggttattgttctgaatgttgccctcatcgctcgaatgcgcccatcccccaaaaaacgacgagcggaggatttttgcgtcgcctatttcagaagcagaagacgctagcctttgttgacatggtgtgcatgattttgtttataaacttacactttttaaacgtgaatgtgccctcaagcatgtctgttcctcctttggcgtctcatcatgatcttgcagggaggttggcctcgactagcccgtggccgcatcgatctcaagcgcttgcaccctcacttaatcaagcacactggtcgcctacaacacgaacagggagcattctgaaaggttctgatgttataaattaatatactggaatg

SEQ ID NO: 7588 - DNA, 700 bp, Nannochloropsis_gaditana
gcgatggcgatggcgttagcaggacgtgggggcgggggaaagcaccagacggcgcttgtctcgacgctcatgcaattgctttcttccagcggcgggaatggagaggacggtgggagcaagctgccgagtgtggggagtatgctcagcggagcttcttctacagcacttctctcgaaagaggccagtgttcttgaggcgtcgagagagatggcagcctcgcgtaaggcatgcctggtggtgggtgagaacggtgagctgatcgggttggtcaccttcaaggacgtgttggggcgggtggtggcgaaggggctgtcaccggggggggcgattctgggcgaggtgatgacgcccaagcctgggagcgtgaccccggacatgtcactgttggatgcgttgtacacgatgcgggacggacacttcttgaatttgcctgtggtggaggagagtggccgcgctctggggctgctgagcgcgatggagatcgtgcagagtctgagctcgttgacagggaaggacgacggcgggaggtcgttctgggcgtcgacgatggcggaaggagacgatgcgtgggagtcgcagtccgaagctggctccatgcgcagcgggttgtctggggtcgggagcatccctcatatcgcgctccgaggcaagaaagattcgtccttccggcctgtctccaaattacggccccgcaaccctt

SEQ ID NO: 7589 - DNA, 700 bp, Nannochloropsis_gaditana
tcgatccctcccaccacagtgagggaacgaccggcaaaaatgaccactgccagcatacagaccaccccgacaaacatagcgagcgtccacgaataaggaaggcgaagcgtcgttccgggaacccgatatcccaaagcatcccgccgtcgggctgcaaacgacgaccgcattccacctgtgatggaggcagaattactttaacaacgactcatcatgcatttgaagccatgaaagctacaaattcggggaaccaaaccttcgtcttcctcgcaatgggcctctgcttttctgtgcatccgttgggcagccgaaaaagccgagggacttgatattatcccgtgtgttttattgtcaaagcacacgttcgtcgagtctctctatactgctcttgagctaatagaatctaagtaccgcggtgttgtttgcgaataaaacatgcatttatgacctctttaatgaaactatttcatattgccttaaaaataaaccctatcacggaagcggagccgttgctttgctgccttttgactgacgggaagttttcgttttttagcgtgcaggctctcgcatgctcacttctctgtccgtatcaatacacacttggtggtcccattttctggtcggacgggcaggatacgcttttatgacgtcgcaggacctgttgtaatagtgtgaaagtatcatagtttcatgcgtcatg

SEQ ID NO: 7590 - DNA, 700 bp, Nannochloropsis_gaditana
gcttgacttcgttctccctcaagtgtggtcagctccgtcctaatactggaaaagggacgaagcatcacccataaacatttcatttgcggcctgacatctcttacttccgctgccatacactttggcgctcccattcttattggcccattccgacgtgcctgaaaagtactcctgcccttttttggtgcatgtaaattgccacctccaccttgacaaactggcttaatgttcaaaaaagctagatctaatgttttttttttcctcaactcgttcaaggaggccccatatcaagaaaagtagaagcgcattttccttcccttttaacctcctccctgatacgatcgcctaagcggtctttcccccttcagtgccggtcgctgctaccgtggccacaatcatcgacggctctaaacacaggactccacgatcacgggttgtaggtgtaagctatacttgtatccgatcttactaacgcgtgctacgttgggggtgcagtgattttccattgcggtagaatagcccgctctgcgacatcatgttccctaaaaccaatttcccgcactcgaactcaattatttacgagtcacacgcatatcctcatcacacatgcccacgcagagagattgcaggaggaaagtgggtggacggggctggtgaagaagactggcaaaaagggagaaaagtcgttttcaggcgcatg

SEQ ID NO: 7591 - DNA, 700 bp, Nannochloropsis_gaditana
gccagtccccacggaaggcattggggaggtcgtccgcctcctcctccgggcggaggcatgggcccgtcaggcgtgtcgccgccttggactgcacgtggacggaaagggggggaaggacgtgggggaggagagggagaaaaggaagggagggaccgtgggggaggtgtctcgtttggtgaagaaactacaagccgcgtacgaagggcgggagggcttgaccgaggacgggggcgaggaagagatggagttccgatacttggacgcgctggaaggaggactcgcagacatggtggaaatgatcatgtccagggaagagagccagcagggtccacgccggggcggggagggagggaaggaagtcgggggccagggggcgcgggcacgcggggcgaacggggtgggctccgaggcccctttaggggacaagggaaaggggatggacacagagcgggaggaggtggagctggcgggcggattagaaaggatgggggagcccgagtcaacggaggccctgcctggcactggcggtgggccgaagggccgggagggtcgccgaggaaaagggacgcgttatgccctgctggtcagcagtacgcagcgtgcagcccgatcgacccagaaaacgaaagatgggctgcaggagaagcatggcgtgttggccgaagcccgagcacgggctgttgcggcgtctggctccacc

SEQ ID NO: 7592 - DNA, 700 bp, Nannochloropsis_gaditana
gttggaggggtgaccccacctagttgacgatgtgggaggcatctgatgtcccactggtccctatcaaagggggggggaatcaacttatgattgctttcccttggttcattatatgactcgacttgctcattctttatacatatatatgtatatatatatgtgtaaatacataacgactctctgtccacctgtgtacggcactaagtcgtcacacttcccaagtgggacctccacagcgtgcaaccgagcctttcccccaaacaaaaggacacgccagcagccacaatgttcttaacactgtgattgcaatcgaggtatcatatagtcaccttcctacttacggcactgatgccgatatcgcgacaacatgaagatagctttttgagcctttattaaaaagcagtcaaggggaagaggggaggttaccctggctctacaagttgtcgctgctgcctctttcagcgaaaactgtttgcattgcatccggtatgcgtgagtgctttatgtgcccagtctgacacgcccttctgttcaaacattgtacatcctgtgctgattcgtctttcacccgggggcaggaaaattacgcggcatcggaagaccatccacgtaccccttgaggttgctgcaggtgcttgcgatggtagggcctgccagagagggtaaaaatggaaaggtggaagaggaagacgacgaaatg

SEQ ID NO: 7593 - DNA, 700 bp, Nannochloropsis_gaditana
agtgccattctccgcgatcgggttgttaattaagctgttaattacaactctatatcccgtcctagatgccgtaatctcaacgctgcggccgctcagcctccccttctccgattctccaaagccaaaaccctcaaaatcaatgccagcaggtggcacttggccgtcctcgccctcctttccggcttgaggccgtccatcgcgggtgcagtggtatcttgagcgtggccagacctcgatctaagtccccatcccccctttcatggatgtcacttgactatggcatatctttctcttcaacatgtcattgcacgacttgtccgtagaaaaccctgccctcttccgcacattgcaattattgaacgaaaagtcgcacgagcaaccttgtcgtctggaggacttgaaggcctgcagccatcaggcaacgacatattaaaggaattatatgaccaattcacgaccgttgatcttaaattttggccacaggagcatgttctaagatctatagaggctaatgtagatgcaaagctttcatgtcacccctcaccggctggacacatgtgcagaaggcgctgccgtgaggcgggcgttcctgggccttttctgcatctctatttctcacccaacacatcccttccccccttacgactttgatatatagattgttggcatccaagttcaaatttatccactttccatcatg

SEQ ID NO: 7594 - DNA, 700 bp, Nannochloropsis_gaditana
aaaggagcgtgtcgcctcgttcttcttgtgctgcgtggaaggcaattattgcttgcctgtgtacagtaggtcatgctgtcagaaactcacggctttgtgtgagagtaggcttctagacaagcaatgcacgggacgtgacgtaccctggctctcaacttcaggataaaaacaagaaggccatcgtcccgggaaaacaaaaacacctggtccggtcaattcaccggacgccattcctcttgtcttcggtgtccgatggtacaagaacgcgtgccgaagtcctcgtgttggggtggccttgtcgcggcctgtgcagtcccatgtctcggtgctatcacccccctcgcccactaccctcagcgacacgcttgtgcatttgaactttttgctcctcccgcacaaatcaggactcctgtgcccggcttccttggtctatagcatcccattgacccctctgtgctagcattgtggcggcctgcttgcgacagcgcggcacttttattgctctcgtattcattttaacacgtcaaatgacctcctttcccaccggcccacgagtaggaaaaattggtcagtggcccccgtcaaccccgcgagacgcggacaccacgctacccaaagtaaacaagcgaagggattgcaatatctgaagcggctttcctctgcgtccgagtgtttcttttttctgccgggtgcgtggatg

SEQ ID NO: 7595 - DNA, 700 bp, Nannochloropsis_gaditana
acgaggaggcggctcgttggaatgtgcgacgtggtctagtggacgaaaactgcgtataaaagcatgagactatgcttaggagtgagggaaaatacaatgctaggagagaaaggcggaggacgctgcccatgtccttaagcttgctgcaaatagaagccggtttccaacccgaaaaatcacgatcaatctcgcgattagacgacagcaggagtgcgtcctgtggctatgagtgatagttttaaaaccttgattgcgagtccttcattcgagaccgttgcaccttagccgcttgaagaacaaatacagcgcctgcccgtgctcgagacgctttcttgttggaaactgtactttgaacatccagggggactgacgagtaccaatcatgcatatgtggcctgttgaaggtccagttgccatgccatatttccatgaaaggctctttgcccttggaaaaaagggccaaaatgcagtcccctggcccctgggagggaaaagcgatgacggtcgtggtgacgggcttcgacatccccccctcggagccaccaagacacgaccgtgtgcgcaaaactcatgcccccaaacaaacttcctccatcccctgggtgccctccgtcaccgtaacagacaccggcaattgagggagcgcgtgtggatttttttggggctctgcttgcgggctcccccctttccgtcaatcatg

SEQ ID NO: 7596 - DNA, 700 bp, Nannochloropsis_gaditana
gaaagtctttcacgtaagggcgcttgtaaaccaaacagctattgaggcaccatgttgtcgtaactcttggtagagcgccttctgcatctgtaagcgtacatcgaggcgttatcttcgcatcgaccgaagctcctcctctcttgctgccatccttctcacctgccctagggccctccccaacgaagactcggtgcacgagcagtccattcaggtcgagaattagaagcttcggtcttcttcgataagtgggaactagggaacgtagacgctgggatagataatatcattcgtacgtgtgtgtcaaatgaaatcgcggtgcaaaacttcgaaaaagcaagaaactacgtacctctacttctagctttagcagcgctatttctatgttttctctctgacctcctccccttctatccctgccgctgtcgtgtgacatgatactttaacaaatttaaaggtatgtatgagttgtgattttctgtgatggtggcaccgtactctgaatgcagtctgtctaggcgcaagcaggaggttacgagactcgaccatgagggagagagagacttgtacccccccataataacgcttcctaaactcactgatatgtcatgacaagccgtgtattttacaatataagccacattcctgtatgacattgcttacggccacgctgccagacctttgacagggtcgcagcagaatg

SEQ ID NO: 7597 - DNA, 700 bp, Nannochloropsis_gaditana
gcctcgaacgcttttgatgaatagcactctgtcgtttttcgaacaaacctcttttttgagataattgtgtacaagaccctcacgagtcgttgtcatgcacgtttctccaggcttttcaggaagctcgtgaccttagctagatctggccactgccggatcataaataggagtcttgacttccttccctctcttcatgctgccaagacaagcaacgatgcctccattttccggtagacggagatccagagcactgggaccatgtgagccacacctgtgtctcgccttttgtcttggtgttttggtgcatcgtcctttttctctggccgccgctgcgagggatgcccgcgtcctcccagtgccggacgacaggcccacttcaagcccctccaaacaaccatggcaccaccacatgcgcccgcttgcatttatgcataagtctacccatgttcccacgcaaatcttagtctcccaaaggcctgacaggtgcaccagccctgtgtgtgtgagcgcgactcccacacatgcctctgaacacccttcatcacaagcacctccaccaaaacctcgcaaatctacctgggaacgggtctcgaaggtcttcaacaaagttcaggacatagcacagtccgacgatttccaacggcttgcccgcggtacccgtactttattgaaagagatcgacatcgaggtccctaccatg

SEQ ID NO: 7598 - DNA, 700 bp, Nannochloropsis_gaditana
cacttggctttgctctggcggtgggtggaagtcggaagccagctctcggtggaagtggtagtttaggctctatccaaaggagggtgaaggtggacggtgcccctttgtcctccgacaatcgaaatgcctgcacaatatgattgcgtgtaatttgaatattacgaaaatcagtttttcctcacaattcatcctcaagaatggccaaaagatacatatgtacacctgtagatggtgtgcggtacgaggggcatggcgacacgtcgtttcaaccaggtcgacgtccctgcctgacaacgtctttgaaaaaatacaacacggacaaacacgccacgtcgacgtcgtttctgccctacatttcatctgttataagcatgtagcccgagtggattgcttcagtcaacacgacggcccctttgcgtgcgggttttaatgtggccaggactagggagacaggaagggcttgaaggccggggagaaggcttctcgtcgctccgcttggcgagcttcattgcccctgaaacacgtctcagcgcacacaagacagctgtgttctgggatgccaagaatacattctacgcatgtagctctgagttcacacgtttgaatcagtatctgctagtagtcgagcattccagaaccctgagggaaaagtatctttccttacttctaattatgatcctgctctctcaaggaaaccatg

SEQ ID NO: 7599 - DNA, 700 bp, Nannochloropsis_gaditana
tcgactcgctgtcgcaatataccgtgcctctctatacatcatacatacgaccccgattactacgcccttcccaaggacctgtatcactgcaggaaaaagcatcgcgcacattgttctcgtattgcaacaaacttcacatatggaaccccactggttcttcagacggtccaaataccaggctttatgtgacaggaaatggccttgtaagacccggtatgcctgcccccggaggtcgcgacgggtatgagcaagagacagggtacaaagtgcacctaaattcctcttttttttcatcccgcttactattcctggaagccttcactcatctgctaacgaaatgactgaaaatgtgcctgtttgttttcgtctgtgcgaatttgtgagtcaaaaccgacctgggagcagggcgggctctgggagagtcctcttccctcgcagacaaggttgtaccctacacaccacaagatgaggcacgaacgtagagggagcgctgcgaattgttccataggttatgcttcaagtgtgtgcacatacaaaagcgccggcgcggacgggaatacaacgtttttttgtggttgctttgttcctgtgtgggcacaagccttctcggcccctgtttctccaacactacgaccacctgctgcgcttcaaggccacaacttttccgaccgcgctgctcttcactcctgacgtttccatg

SEQ ID NO: 7600 - DNA, 700 bp, Nannochloropsis_gaditana; identical to SEQ ID NO: 6245

SEQ ID NO: 7601 - DNA, 72 bp, Nannochloropsis_gaditana
gaggccagcgcccggcagaagggcgtgaccaagcagtccctgcttcccacccccggcgtggacacctgcatg

SEQ ID NO: 7602 - DNA, 700 bp, Nannochloropsis_gaditana
agcgactcccttggcctggccactaacatcgcgacttgatatcggcccagatgccacccgggctttaagcctcattcttgagagagcgcccggggcggaaggcccaccgcgatgaacggctctgaagacaccgtaccagtgcctcccctctttctgcactcacactccccggacaatcgtgccccccctcccgaagcaccgggacgaaggttatgtgggacgggtgggttggattcagtggaaggaagcgaaattagtaagatggatggcggggcaagatgcagggcaatgtagatgaacgaccttcgctgaggcctccctcgtaagtggaggagaggcaggcctcaggaatggctggcctgctgccaggctgtcttgccaaggcgtccactctatggaagctttggctgtgtacactggtgctgacatgcttgtgtctttgccaatgggcgccgcctttttgctgtgcttttacccgcagcactggaaaaagacgggaagacaaaggctgaccgacactccgtttccctaccacacatgacaatcatgcaggagagtttacttcttctttgttttgaaaatggtaagtgcagtagactgggggaaaggactgaacagacacgccattgcgaaggtttgcttttcgcagtaattgcctggatctcacgtctcttgcctcctcccctccccaatttagcct

SEQ ID NO: 7603 - DNA, 700 bp, Nannochloropsis_gaditana
tgagccgaaacagggcgatcggccttttgaagagttgggtagatctgggagtgatgatggatggagattgtgaccctacatttggggcctttgcggaggtaagccgggggcatcgcagaaggtgtatggtgcgtgcatagtcatgtaggtatcagatatattgtccaagagatttcatgatatgtgtcaatggtcaggtagaatgtatcttttccaagcaattcgaggtcacacaggtccagtagtcaagctcccatcgcacgcgcctgacatacccccccacggacaggtcaaagctgcctttcaaattaatgaccttgaattggaggacccagaatgccttgcctatgaaccgcccttgcacgcagagaaaggacggttgtgggccgcgcgggcagaccgggtgctgggagaaggcgccaagcgtaagttcaatccttgacggtgccagtggacatggtgaccctcaccagatatccagcactctctctccttttttccttgctttgagtcggactgtcacggtcccgtcgtttccggtccgcttgcgcttgacctgtgcttccttttcctttcgcgtcccctgcccctcccctttgtctccgtgtgtcgcagacctggaagaaaatttggtgtgccgacaagcgaacaactcgagccgggcagtctacatggctagaatggattgcaaggaccaatg

SEQ ID NO: 7604 - DNA, 700 bp, Nannochloropsis_gaditana
tgtattcagcatcgtcccgggaattttgggcgagtgcaggccgggagagcgaccatgtccgatggtacactttttgggagtagttttcgtctgtcggcgcaactcaaaggccatgaataaaacttcaaaagataataatattgaaggaatcacaatttataggtctgggtgtagagtcgagagattttgtgtctcagcactgcgcatggattgaccgacggccggttgccaacttttggggtcggccccccttttctagcccttgcccgtccagcaattaaaaattatcaacggcataccggcactggaagcttcgggtttacaattttggcttgccttcctaatactgtaccgcggagaacgtatgatattacagaaaaatgccttgcacagttagcgcaaagggaaaacgtttctccgccattgtactttttggaagagggaaagcgattgtaaaatatggctctccgctacgagagtttgggctgttgatacatgtgaaaataagtgtggacgactttgaatgacttgatcaggctgtttgcacatataaccagcgcgcatgcacttctgacatgtcaatgacgaaatttcacacttcaccaataaattgtatccttacgttttgtctttctcacacgcacatatatgatcatagataaaagccaatatcaagaagctgtcttttttgtgaagcatg

SEQ ID NO: 7605 - DNA, 58 bp, Nannochloropsis_gaditana
cccccccccccagagttgatctgacgctctcccttcgtcaactggcatcgaatcaggc

SEQ ID NO: 7606 - DNA, 700 bp, Nannochloropsis_gaditana
agagctaggcagcggggaggatggaagtcacgcagaaatgcagaacgaggagagggaccggacacaagactcgggcacttgcacgaccctccaggggcaagaggggcagaaaactgtgaaaaacagtgaagacgacacagttcgagtacttttggacgccctggaggatacagcgattctagatgttcttcgggcaaatccctcgttgaccaaagccgtaggaaggcttctcccattcttgacatacggtcgcatccaagcctgtgccgttttgacagaaaaaattgtctcggagattggctgggttcgatggcaagggcgagcggaagacaaaaatggacggcaaaaatcgggcgaaaaggaaaaagaagaggagttggggaccgctgccgcctcctccctccccttgctagtaacaattatgctcgaagcactttatggcctcacaggatgtcgacagggagggtctgctcctactacgatacgcgatcaactcttggagcgtggttttacagcggccacgcttgaagccctgcaaagcgtgttgcccattgaggacggcattgggcgtgcggtgcaagaaagtgggtctcatggcgacttcttgaagagaaaggaacgagtggagggagcatggaaagtgcgcctggctgcgccggtagttttgccggctttacgggtgcttgcgggcttagcaagg

SEQ ID NO: 7607 - DNA, 700 bp, Nannochloropsis_gaditana
tggtgaacctgatgaaaattgtgtgacgttcatgctatcgttactggatgagacgctttcggtccctccatttttgcaaaggacgaaggatggcacaggcgataaagagaatcgagggtggataacattggggcagcagcgagtgcggaaagcgatgtcacacttactcttcaagtggaaggccagaatggcgagcaaggcaagcaaatgcatcgacaagcacggtggagatagaaaccaggaaagtaatgcgtcggcttccaccttgcacactttcacctttacctcctccctccaagattttccttcacatgaggattggtggctttaccttcttgtaaatcccaattcgcttcctctgcgtgtcgaagctggaaacatcatgttaaaccttttggagatggtgaagcgttatttcttgcgcctccaacgccaacagcaacagcggcaatttcgaccacttagcaagccaagcaccaacaatgtaacggctgaaagacaagttgaaagcacgagcgatatgtccgtcgacggagaaggatataaagaagggtgcgagaatgaggaaggagatagccgggaaaagggtggggagggtggaatcaagacacgggcatccgctttgccttggatatcctcgggggaatcccctcctttcgcttcacattctccaccttttgtgctgcagattcgcctgttt

SEQ ID NO: 7608 - DNA, 700 bp, Nannochloropsis_gaditana
cgccgccttgctaaagaatatggggctcttaactacacacacaatgattgacttcgcgtatcgggcagtatattccccatttctgcgaacaagagaaatagctgctgtcctttttcggcgcttttgggacgagttacccctagaggagaaggcaacatgtgtggagcagatcactcaactattgccttctttcctttccagaggttcggatgcagcggacttgctacaggcgatttgcgctatattggaaacggagagggacaaaacgaagatccggagcttgacagaggcttttactcggtcatctacttataccccctatttctctgcttctctccccttctttgagaccctcgttctactcttggaaacccagcttcggagcataaagaaccatcctgccgctcctatatacgaagaattgcatgtgttgaacggccacaaaccccttccaaaatatttggactctacgccttgttcctcctgcgttccaaagtcttccccgtcgatgtctacaggcaagactagctaccgacttttgcctttggaaagcctaaagagcgtgtatcgggccacggagaactgtcttttcctgtccctacgctcgtgctaccaagttcgacggatacagctcaacataagcgacgcgcacagtcgttacgtcaaaacgattcgtctctatttcctacctcgacaacag

SEQ ID NO: 7609 - DNA, 700 bp, Nannochloropsis_gaditana; identical to SEQ ID NO: 5065

SEQ ID NO: 7610 - DNA, 700 bp, Nannochloropsis_gaditana
aagaggtcgtggaagcgataaggatgcaccaaatcaggcatatgaatgcccaggctttccgctccatccaaacttctcagacgatttgatcagaaattaaacaatttcaggcattgaggctctgagatgccgctcgtggtgtagagaggatgggaggtcggacaggcagcttttgtgtcgtcgaccttcttttttggccctttaagtctgtgagtgcgttatgtacaggaacgtacgtcgacattgtgagattatgcgaggaaaaatgcgcatcattggaaacgtaggattacccggggccgcaagggcgagcggggcgacgccagagaagcccaagtgctacaagaggcggccgcgttctttccgctcgccctatagtatgctttagctcgtcatttaccacgcttcaccgttgtgtgcgcatgccaacattacggacgctacgcttaccgaaacggccgctttcatcctcaaagttgtgacacgtttaagagaggatgtctctttctattgccttggaccgaaagtatccaacgtcactctaagttgatatcgatgggttgcctccccataaccatcctacaaccacgcacagtacgtaaggaaagcaatatggaagagggaagtcaggggcacggggagacagtgcagctcctgtccttgcttgcagcgctttcagacctccttcctcaccacgatg

SEQ ID NO: 7611 - DNA, 700 bp, Nannochloropsis_gaditana
gatacaaatgacccccttgtctgtcgaaattgatattttcttgtccacccaacttcttgatcaggggaggttgactctcccgcccccgttgccctcccagacaaagcgagagcccggtcgctcttccttttgaggaactatttcataatttctgaggtcgtccgtgccacgtccgccgtgacggggtgtctcgtcgcacaggcatatgtgttggcgcattagcctgttggagggtcttccacgctggcgttccatgcttgtggcacgatgtatacttccaagtctggaagtctgaaatggcgaaccctcacttcatattccatgttcattcttcccgcgcccacacgcctcctaccttgcaagcaggacttttgtcacgcaaacgtcatactattgatgattcgtcgtagcttcttacagccatcttaagtcccgtaaagggttggccacggggccgggcacaggagacagggcgctcgtgatggccccgacaagcacgaataaaatagaaggcagtagggcgcctttcgcaagtacacgagtggagggggagaggatcagtaggctgcatgaaataaatggccaccacgatcaccgggagagagaggggacgccgactccggctttggcaggcacaccatcctcatcgctttacttgacgcctccttcctcgggccccgcgcgcgattatacccccatg

SEQ ID NO: 7612 - DNA, 69 bp, Nannochloropsis_gaditana
ggtggaaaaaagcgattggactatcgaccacgaatatttctttttacgagctttattcctgtctcgcag

SEQ ID NO: 7613 - DNA, 700 bp, Nannochloropsis_gaditana
ccatcgccgggccctcggctgtgacaccaggcttggtttcaaacccttccatggaaaccgaaattttgcttcccacacccctccgcctctttatctgcatggtttactcctgtacgtgggtgtaatacggcgttgagtggagaagtcacggtgtatggccattcccgcaggccttcaaaggaagacgtcacgactggcgagcggagggactctctgcggccatgcttgtttatcgcctggatgcaaccaaaaaatgtcggacgagaccgctcgctgtccctgcccatgtccgtgcacgttgaggaagtgcgaaggagatgccgcaagtacgcgcatgggcacgttttgaagtatatcgtgggagtgaggtctcagtgaccgccggcgtcgggattgctgcgtggtgacggccgtgtcttttctatctctttatgatattatcgtcttgccaagctttcatgcgggctggctccccacgacggcaaaagcaccaacccagttcgcagatttaaatgatggcacggtcgagtgttcgtaaacatgtttgccatctgtgtggttatctcaggggtcttgggggggacaactaatgaagcttcgtgcagccaaaagaagcccacactcatgtcgttcagtgtacctcttgggattcctttgtatctaggtgtctcccttgggcgtggccgtaaaagtcaccatg

SEQ ID NO: 7614 - DNA, 700 bp, Nannochloropsis_gaditana
ggctgtgggatgtacggaatgagatgtgagtacataaaagcacttctcagtgcggcggagaagggatgacctcctccttctgcgccccaaccatccatgatctctggagtctcaggtattcgctaccgcggataaacacacagccccgttttcaccgcatgccatgcatcatcaagatcaaacgtttgaaagacctagtaacccatcgtccggagaaaaggcgtgacttagctgccaccagaccggctacctgacctctccagaaaagagcttctagcgccttctaattcgagctgctcactctccttgatgggaccattaaaaagtaccgtggaagcccaaaaagcgtgcatgactggccggagggactactgtagcagttttgctatcttggcggacatataccactttttaatatcattttgcacggaattagttttgctttcatcctcctcctactaggagtccatgctttcttccctcatcacgatgtctaatataaaacaatgtatgtatattattattcccccggctgtgcatccccgccttggacatgcatcgagctgtacatgctgcaacaaaagaagatagtcctccatgtagaggactccgcaagtcgtatccttcgtgtcacaaactcatacggtcagaatttcaacgtcttcacaggtacaaggttgcccttgccgactgcgcgatg

SEQ ID NO: 7615 - DNA, 700 bp, Nannochloropsis_gaditana; identical to SEQ ID NO: 4509

SEQ ID NO: 7616 - DNA, 700 bp, Nannochloropsis_gaditana
  misc_feature (1)..(552): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttgcatttgaattgaaacatagatctctatttttgagtcttcgcatttctgatttaggtcagtttttggaaaagtaaacctttttttaattctaaattgactgcaatgtcgacatcggctatcacagtaccgcatgtaatg

SEQ ID NO: 7617 - DNA, 700 bp, Nannochloropsis_gaditana; identical to SEQ ID NO: 4591

SEQ ID NO: 7618 - DNA, 700 bp, Nannochloropsis_gaditana
cggcgagcgacttttggcaaatgtaaatatgcaaagcttttgtaccatagataagagagtgtgtatacagtgacaaattaaacgattcacacacgtattttcatcaggctttttttcgagatactttctgtcggatctcgttgcggtgctgctccaccccgcaagagtgccagtaaactttcttggtcgaaatgaagtatgcctacgattgtgcactctgagggactcaataagaatcttggtgattggcattcaaaggcgacgattagaaagtgccaaaaagtaagcactttgcggatgacatgtctaggacgatatgattggatagtcattccaagtaaaacatgcctgcgcataacacgagagtgcacacgtcagagtacaaaaagcaaaataaaagtttagcagagagccaaacctgaatattcctcagtctaaggtgattagataaaacttgacaagcgaagtaaagcctaatacactgccactcagtcttcgggggggaggaggttgttctacgttccaacagcaagatacgaagtcggcagggaggccaggggccacgcgtggagcctcacgtatgccatgtgtgaagccagcatcttgcttgtccatctaccatctgtacatgcactgttatgaggagaaagcctcaccgagagtccctgccatttgttcccctgactttccccaggacatg

SEQ ID NO: 7619 - DNA, 700 bp, Nannochloropsis_gaditana
tttcctggatgtagccaaggcgggcgagcttgcgtccggtgcagcggttggggtcgcactggtcgaagtcccacatctggagcttgatgggaaaatgcttgcgctgatgctcccaggcgcccatgctgctctgtgcgttttcaaagttcgtgccaagattcgcctcctcgtcatggacgacttgccccggggggaggggaaagccatccgagggcggcccgtcccgatactcccgtgtcttgaaacgagaaccgcggtggtggtggtggtgactgcccccgctgtgaccaccgccgcgtccttttccaccgcgccctcgcctgctaccggaagtggtccttccctccacagcagcgtcggcttttcggctgcatttcatgctgcacttgtgctaatagcggaacggcaagtcaaagggaggtggtaggagcttggcaggtgacgtgatttcccaaacttcaaggctgaattaaggcccgtggtccgcagtcaggatgcgcttagctgtgcgtacatacaatagaaatatcaggagcatgtcaatttcattgcgcatagtctcgcaaagaagcgcccaaggtgggttccaacttcgcatttccagcctcctatcgcccggtcacgtcaacaagtcgctctccgtctcattcccatttcttcaagcctcattttcttcctgccactatctcacggcgctcag

SEQ ID NO: 7620 - DNA, 700 bp, Nannochloropsis_gaditana
tcagaaaaagctccagtgctgtggaatatgctgagaaacgcgttgaggatcggaaacgccatgcttggcccattaggacttcggccatgtgtgcttgatgtcgggtgcaggcacgctttaaccatccttttttggaatggagcactgtcagcacggtttgaatgtatgagactcgctcacgatgcaccgagagcctgtgtaccgtcgtggctagcattgacgcctgaattggaagggaaaaaaagtgttcccgacccgagaagcacgaaaaaagtcgaaaacgattttttcatttgctacatctttgctcaactgcttatttcatttatttgttgtatcacaaggcgaggacgagcgtcttttttattcgtgtttttcttcgttttttcacccttcgcttgccttttggcccatagtgcgaggctgcggcgagagcgagcgatcgattcccagcaagtgcccccaacggaagttgacaaaaccaccatatacaccagcctggcggtattttcaatccgcacgctcacgtctatattgcacagggtaggaccacgggcaccgacgaccgtgcataaggcacataacccgagtccccttcccatcgtagctatcgctcccacgcttccgggtgccaggacaccctgtctgcgtgaattatttacacaccacgaccataccgtactggtagccaataagcatg

SEQ ID NO: 7621 - DNA, 700 bp, Nannochloropsis_gaditana
ttgctgtatggccctcttctctacgggtgttgcgccaaaaggcacacaaacgacaactttgggctttaaatacttgctgcgtggtatcgcttttttgaaaaactctttgatcatcatctcggcgtgatcaaagtctgcaattacaccatcgcttaacggctggcttgcgacaatgctttctggtgttttgccaagcattaactttgcaccgtcacccacggctaggagacttttctttccttttgaatcgtggaaggcaacgacagaaggttcgtctaggacaatccccttttttgctgtaacaatgacggtgttcgccgtgcccaggtcgatgccaatctggtgtgaaaacatagggatgccttggtttttatatgggatgcccacatttctggcatcatgcaaacaatcaaacgtatagggtaaaaccctggtcatgatgcagaacctttggagcgcctcaaacctcagtggtcggagcgttgtgtgaatcgcatggcgctgtggttgcctggcttcttaccagagccttgtctgattggtggttaccgcgggcgtttttctgcggcgcttggcgcaccagttgccgaataaagcgggctgatgcatggctgtcaaattttcaggtcaagataaaccacgaggcccaaggctgaaatgactcgacaaaaccagttttgtagttattatggtgcctatg

SEQ ID NO: 7622 - DNA, 700 bp, Nannochloropsis_gaditana
gacgctgcttcagtttcgcatgtggaagatttgtacaaaggatgtgtgtgacattggaggtttcgtaggcagcaacgtgtcctccgtgctcgtgcactagagcccgcagctcctcgacaggcaagggagtgaagccattgatgaaaaataccatgccctcaaagatgcgactgataggaacatcctcctctccgcttttttcattgagttgggcatggagacgttgtattttgtgttgcatgtagacaccaaagtcacccccatggggctccccaacaaggggggggggcacggggcgcttcttggctgaagacatctaatcatgacgtgtgttgaaagaggatgacgacgatgcacgcaacgcacaccaggcagtttaagtcacaggcgtgcccatggtccctgtacttgcgtgggtgtccggtgagtgaaacatttagtgcccctacgagcgtgctgctaccaggggagtgacgccatcgtctccgcgctctgccggggggggaaaacgcgaggaagcgccgtggcggttttcgcaccctgcgggtccgattttgggaggtagggagcctaacaacgggatccaggcggtaatatacactcaccatttctccctgtgtgtggatgcacatccgcaggttggaggagtagaaagggcggggcgttgggcccaagacccacaggtcaaacggccacgatg

SEQ ID NO: 7623 - DNA, 700 bp, Nannochloropsis_gaditana
acatgcagatacttggcgtagtgacggctcttgtgtggcttttaatgactcgcaatggcataaaagccgtgccggagtctgcgagcaggaacgcaactacggaggcaaggaaggaggtgcatgctccagcccttgaatgcgtcctcccgcgcctccccaaaggcttcaaaccttttcccacatccgtatcagcattcatcgcagcgtcctccatggagaccctgtattgtgtcattggatgaagaacgaggggactcagaggacgtgtgtaggaacacagagggagacctcgctgagatgcgacgcgctgggggcgggaggaaggagtacgtcatacctatatccccaggggaggtcggacgctgttttgaagcacgcgtagcgaacgcatgcaatgtgcgccgtgggagaatgatgatgtcgtgctggattggcattttatatgctgtactggtctgcgtgagtctgcaacatgcgcgagcgaagttggtagtctgtaggaccttttgaaaccgcagcatgggacttcgtccctcctctgtgtgacaacacttacgacgcatttcccgcaatcccgcacatgacagaggggggaagactgccttcgtgacttcttctttacttcttgttaccccttcgctacagtctaggagctttcgcgtgagaccagtctcctcattgctacagacgctcccgaatg

SEQ ID NO: 7624 - DNA, 700 bp, Nannochloropsis_gaditana
acgtaaaactcctggcgcaaggtatagagatcatcaggctccgccatattagcttgcctctgtgttattgtgttctatgagcaaataccttgcgagggatgtagggaagtacggaacagggcacccatcatcgctcaaacattctcaggcgatgggatggccagggatagacctacgaaccagtgtgccacctatgattcacgattccatgcatgatgaaaagtgccacctttcttcctctcatgcaaagcatccaacgggctcgcgatacattttgaaaccccgagcacaggcttatgcctggaagcctcaatagtcgcgggtgccgtcccgaaagagctcatctatgatggaaaagacctcatctatgatggaaaagacctcatctatgatggaaaagatctcatctatgatggaaaagacctcagccccgacttccctgcgacagagcgaagcggaggcaggcagtcaaggtcttacctgaacacaaaacaacgcacgaaaccgtttaatggattggaattcaagtgtgaatattgttgggatgtaggacataatgttgggactatcaacgtctaaccgtacgatgtctcgacgaggatgatcggatggagtgttgcaagagatggaagtgaagaaggtttgatagggcgttccacatgcacttcttttctaacacacagacgggctcaaatccatg

SEQ ID NO: 7625 - DNA, 700 bp, Nannochloropsis_gaditana
atttgtattcaattacattcatgtaacatctattgcaataaccaaaaagtgaaattaccaaaaattataggacaagaagctggacatagaaaaatcgcccagcagcatatgcaatagttgaaaaagttctccgctcacccaatacgcttttttcgtacattacgtggtcatttgaggacatccaaaaaagtatattacaggagtcgattgtatggctccttgtgacgcaacagttggtactcattctgtgaaaattgactggattcttctctcgggagggtatatttgaatcaaaaagcaaacaggccggtttggcttttttggcctgacggggacaaagcaaccaatttcctacaaacaacttctaccgtgagtatatattgcattatgttataaaacattttggtcgcttgctcatgaacaaacgtttccatcatatgtattgatttttcccatgctgtgtgatattttgtagctatggcgtcaaaatgatccaggaccgttaagcgcctttggtgtcttttaatacagtcctttagatgcgcaaatagccattcgacattgaaaattatcgatggaactattgttgattgcaatgtggctttttttgcttgcctccagctgcttatagtccgtgttttttaacaccgaccgctttctcttgcaggatacatcagggggcagcagcggggatagcatg

SEQ ID NO: 7626 - DNA, 700 bp, Nannochloropsis_gaditana
ctctcggagtacgtccctaacctgacccagtcgcggcttgtcgccactccgccagggtgggaggcgcgaggaaagaacaaggaggttcgccttttccaagagggggctcagaccattgtgggtttcaacttcaaggtgcgctacgccaagatccggcggtgtcacacagagtagtaatagcagagtagttctgacagtgtgaatggaaagtttcggggctctcctctgcctctttcagctcgtcttgtttgtttgccacgtcttctgtgaactctccctttttaacgctcgctctatgtatccgctctattgaaatgaaaggcctctttgacgatggatatggaagaagtatttgaagctgaggacgaaaagctaggtcagcgtcgtataaaattccgcttggtagactcggccatgttcagtgatttctcgggtaaggacaaattttccatgctctgaatttgagggggaatgggcacatcaagattttttatccaagaatttatccaagaatcagtctttataagtggtaggcactccttatttacaaattgccttccttcccatcggtccgaatctgacctccctacaggggaatggcgcctacaatgctactcaaggatgcgcaccgcttgcgaaaacgaggaatggacttacaggtgaagagcacaacaacaatttaaggcgcacatttacgatg

SEQ ID NO: 7627 - DNA, 700 bp, Nannochloropsis_gaditana
ggcgcttggagttttggcgtgaagtctgcgggtcgtgggaagccagaggaggtgggcaggagaaacaaggcgaccaggcaggctgccacagctgcagcggtaggaaaacccaaacaatgcatgccttctccttccgcaaacaccggaggagcagctgcactatactgtggaatcaaggaatgcttgaaaatcatttggggcctggcgcggggtggttttgtggtttgaccgcgtgcaaaggcactttccggtcctcgctgtcagctcccgttgtctcggaaagggctaggacgagcctcccctaactgaatcacacccaagttgcacaaattgtaccggctcttggaggccgcgagcaccgttcttgtgcgttttgggacatgatatgccgtgtggtggactaatgggtgctttgtggcggtaaagcgtgaccgttcatggcttcgacgtgcacgtatatccagcccccctccaaggccaagagccttcaaccgcagtgctcaacacgtcacacgatctctccttgtctatgctactgagcttacggctctatgtttcgtaatctatccctgacaattaacctttttttcgtgaccctccaatagtacattgttgtctataggcagaactctgtagagtgtattagcgtgcggagaagccttgctgtcttctcgtctcaagccgggctcaaccacgcatg

SEQ ID NO: 7628 - DNA, 700 bp, Nannochloropsis_gaditana
aagtgtgattgttggattttcttttcttccggtccaaggactccaggcgggccatcaattcctcatggagtaggaggttctctggaataaagcctagatttccagccgattcttctttttcaaactaccaaagcttaccacaagaaatttcatagcagggccctaaaatcatcgcttgtttaatgcaacccacgcggcgacacacgtggggatttcgtgttttgtcgtagtcttgggcaaaacgttttaacaccctgcccactagaacctatgctgccacggaaccgaatatatgacataccactcttgacgtcggtagctagtatatgctcgaaatattttttttgttgtttgcatagatatatacatatcttttacgctgggtcctgtgtacctcggtcattgtttcgatgctgccgttgaacagaagcttacccggaagctcaaccctcaaccctccctgccatgttttgtgacaacacagcttgcattgggtcctttggcgcatgtgttgattctgtattgtatggatagtgtgcagtgtacgatcttaactttcttctggactttgctattgaattcgacccgccgcatcatctgccaacatgcgttgttgcatgcgaaccttcagttgttgagaccaactggcatattttcttctttctccgtgcacccggataattaggcctcaatcatcatg

SEQ ID NO: 7629 - DNA, 700 bp, Nannochloropsis_gaditana
cagccctgtctgcttctgtctgccccggtacgagaggcaagtcggggcagatatcaaatcttagacaaagaggcacaagacatgaaatgaaccggtggatcattgttgcctatatcgcgggtgctgattggacatgtggtcttggcgcggccagaccccggcttttgaacagcgaggggatgacgtgtctcccccaactctcagaggctaaagctcgtgcatacgtcgcctttgcctgtgtcacaggggtttgcaagatcttccgacgaatcttggttccatgacctgtcttgtggacgtcaatctgttcagtaatcgtacacatgaaatgtgccgcctggtctgggcactggtatctaattatgatggacacgtactacgatttctggagccgagcaaggaagctttcacacgagctttccaattcggcagtacttttttccttggtagagcggcagtaatgatcacttacatcctcttgaatactacggagcaattaattgtgcgaaatgtaccgtttgaatgtgtcgcgacgaaggatttggctctcggcgtgtttgtggctttggtgatagacctgtgatgtgacgcatacgtttccaatcactgccctttccttgttcggctctcatcactttacgagaagcctttgcactcactcttcacaatttcaatacacttgcttggtaggaacagcatg

SEQ ID NO: 7630 - DNA, 700 bp, Nannochloropsis_gaditana
tgcagcaagcaattgagccatggctacgaccgccgcttcctttcttgccaaatcaggactccggagttcctccaagagcttatgtgctttttgatgttgatgcgcatgttgtcttgtttcctgttctgtatccgcacaggaagaagaacgcgcggtccggcctgagggaaatcctacggggtcatgccgggcgtgacgcgaggcgcgcgcctttttggctttccccatgaagaaccccgcggcccttgcctaacaagaggcaggcctggactgatttcgagaaagtatgaggcgattatcttatagaacgaagccttacgcagtcatatttatgagggaaaagacaccagtggaggacacgagtccatgcgcaggaaagcgagggggcgagggggaggcgagacgtttgggtctttcaaaatgccctttagccctttcaaccgcgatatggacctgatatcacgcatttttccatgtatcacacaggcaccgtccaaatcgtggtctgaaatggcggcattagcgacgtgcttcaggttttatcaactctgccttgctgaccaacgctgcagttcgtcacgctgaaacttcaacacgcaggggaagggtgtcggcagaggctattgaaacctacgagttgacactcacgtagtccagactgttcattcgcgtcatgccatgaagcgagaatccttccatg

SEQ ID NO: 7631 - DNA, 700 bp, Nannochloropsis_gaditana; identical to SEQ ID NO: 4907

SEQ ID NO: 7632 - DNA, 700 bp, Nannochloropsis_gaditana
gatggcgtggtcttgctccctttgacttttgtaaaggccgggtggctgacagaactcctactcttttcccggctctccgcttctgagtctccgccagaggcctgtgaggaggcaccgtctgccatgttattggtgctgctagcgcagaaggaaaacgccccattggtggcgccatagtggggtatagttgctgtgtaacaggtgacgcctcccagtccagagcgccagacaatggaggaaagtacgttcaaacgcttcatctggcaacggctagcgctatttatacgcgttttcaggccttgatcattcctttttgagacgatgctaaggacattagacgataagtatgttttggaatacaaacacgaagtgcaaggtcgccaggaaggggcatagcttgatagagcgtgtctgcgggcatcgcagaggctgtgaagtgcatcacatacggagttaacctcccggctccaggtcgctatggcctccatgtccgactgcatggcaacaacaatggggcgtctcgcgcacggcacacgcacacgtgcacacggggactttttttttcctcattccacctcccgattgaccctcattcaggaaaatgattcctcgtcctctcttcgggtcccttttcctcgtattgcttctgacctggccacgacaggcaccatcactggtattcaagcacgcccacatcatg

SEQ ID NO: 7633 - DNA, 700 bp, Nannochloropsis_gaditana
catgactgtgctactagaagccgatactcaccttattggtagttcgtgcgggtgcacgcacgccttgtgactgtacgtttatacttattctgtactggtagggtgtgatcagggataattttctcggtgaggagagaggaaaagagaagtggaagaagaccaacacatttctcggcgtgctcctgtactgggtttgggctgctgttgcaacatgttaaaaaaaaatactgtgcctcatcctgattctacactgttgcatagcggctacaaacctatcaatcacacgatgttgcgattttctcggccgtggccccgaaggtcttcacgaagcgaggcactgatgcccgccttcttccttgccgaaaacaacgcttgcaatcaaagtggccttcatgcctgccaacttgaatgcctccctgcaaatagtcccacgatgggcacaaagagcccgtggaatgcccggcatcacggcgctgcccgcgtgtatgaatggcgaggccgagaaggctggaattcgggcgcctcgcgtcccatgcttgacttcgggggggccgggggcgcaatatccccccccctccttgagagctgccgtccgcattgaaatgggtttcacgacgctcagacggtcatcatcgcaactttgtaggacggctgcaagcacgactgcccaatctacgcgttaaggtcacttgaaagcatg

SEQ ID NO: 7634 - DNA, 700 bp, Nannochloropsis_gaditana
tagtcttgtgctgacgcgtcttgtcgttgtatggtgtcaaggtggttttagaggctggcacgtccgcttcaagcaatgaactcctagctactggaacataagcctgtgtctttgggcgctgcctcatgaatcgcacgggggagttctttgaaagacgttcacacagagccaggagccttcgatgtttaccctgattgggtcatttccgtggttgatgacttgtctaggcgtaatttattttgttgtcacacagcccttttactctcacgattccccgccccagtgcaacctaatcatctttcccatacttctcgcttctgacattcgtattcacaacgtggggaggacgtcatctgatagcgcaatttgagaatagcgagctttgcaggcgctttgtggccaggggtgggtttggtggcacatgtgcaggattttatcgaatatgcgtccttcattttatgctccagcattgaccgaaggagtgcccctcctccacataaagtctgcactgtgcgtagcatcacagaaagcaattgcttcactgtcattatcaatttaaagccgtgcattggcgtcgtagaatttggcaaatgcgttgtcgtccgcttctactttcgcctcgtctcgtcctccccacttcgcttcccctcactcacgtatccttttctttccctctccccttcccgataaaactctcatg

SEQ ID NO: 7635 - DNA, 55 bp, Nannochloropsis_gaditana
ggtggcagcactagtgcgacagaagcgtgctgaaggtgccaaactacgtgtcatg

SEQ ID NO: 7636 - DNA, 700 bp, Nannochloropsis_gaditana
gcacgccttttttccgcaagtacaactcggcataggacgacgatgtggtcgaggacatgctccgaatcgtgctatgctccaggtcgtacttgcgctcacggtattcgcctcgataacatccctcttcctgtacttcttgatttgggcccctatttagtttgtacaatgtaaggaagggaaggctgaatccagcgcaagaaaactcgagcaagcaaaccaggatcacaacagacctccaacatcttaatgccgcgtctttgctgtgcaccttccatgatccgtcccaaaaattgtacgtgccaacaactcacaatgtgcgaaaacgagacggaggcgagcgtcgctcgtttcctcttgcccccgcccacccatccccctattctggtatcctggcctcctgtagcccctttttctcgcagttttgaaacccacagacgctttataacatccacaggactactgaatcgagtcaaacattttttttcgtggctgggttggtaggatggctgtggctgccgcgccaagtaagaacaaaaagcgggcgacgcctacagtgagtttagcctcccctccctcgaccaccagcctagttcctgccaaggactccagcccctccttgatccctcgaatcgtctccgccgatcttcaccaagtcacaccttgcttcaatcatggcggggacgtgctggcttgcgcaatg

SEQ ID NO: 7637 - DNA, 700 bp, Nannochloropsis_gaditana
cggccttcaccctggctcgtgcccttggaggcattcggctcttcccgctcccccctgttgtggatggtagcaggctgccggcgttgatttatacctggcgccgctgagtgtgatgaagaggatggtgctccgcctccccgggccttgatggcacgtggatctgagtctgaaacgacctctccattaattattaagacttgaagtgtataaatcatgtcgggcgaaacggcaggtgaggcaagggaaggacggaatcaatgggaaaaagaacgttcaaaaccggggcaaaatgactcacccattggagaacagtgccagaataaccaggagagagcggagtcttctacctatcgatgaaagaaagaactattctttgaggttatacaattttgcgaaggctttctcccgccgcgttctctttggctgctcctgtcgtccctgcccagatatgagctgccgcgcacacaagtcttcaacgattaatgcggagaaaaatgtaggcatcggcttaaattataataatgtctaataataataatgtagccatcaattcaaagaatgaggtagcaagaggcatgtgagctatttagcattaggcagacagggcctgatctccgcgtgatcaaactggtatttctaacaatgcgtttcaacctcccctctgctctcgcacataaactctccctttttcccttacaca

SEQ ID NO: 7638 - DNA, 700 bp, Nannochloropsis_gaditana
ggtggaggaggcatgtctcgtggccatctcgcaacgtacatgactgtggtgagcaggattacgcgggagattgaaagcgaatgtgacggtggtcggcaggacgaagaaaaagaaaaggaaaaaatgcaccaggtattttgatgttgcgtttgttgccatgctgggacggcaacagtaccacttcgatcaaggccaggacgatagcttaaaacgtaggatctccctgccaggtgcaaaaataatcatgtcaggaacgaagcattatttcagaaggctttatcgggcacatttttgtttttaagcaaagtattccctccacccctcggctcgcttccgctgtcagagagagcaggctcgagcccaaagagaagccttgccgtcttttttccccgactggcctcaaccatgtccacgaggggcaatcttcaaccgtactaacgttgtacgttgcaagcctggaatggctgaacatgtgggtggtcgacccaggcaccatggatcggtgggcttgacgggcacgcgccattaattggctgcaacagagcagggcactgcctccccactcgcacgtcgttgttgatgtcttgggcggcccacgaaatccttgtactttgacatttcggtgccttcagcccacgtctgtacgctttgcacccttatcaaatcacacagggcttggctctctgcagcagcattcatg

SEQ ID NO: 7639 - DNA, 700 bp, Nannochloropsis_gaditana
ttctccatctcgcagcgccagtatgcgtctaagaacgtcctcatggaggacccctcttagatgcaacggggtccccgacgtctcgcgtgtcatcaaaactgcgtaatagtgcgggaagcctgcgtcaaagatgtattgctcgagaataccaaggtaattgtgttgatcaacagtgtattaaagggtgcgatggcattcatccgggtctctttcgggagcccaaaaatcagcgacggtacggttgcttgtacttcgctttgaggctcggagccctaaaaacatacagatttagagctagatattggtcacctttataaaaagtatcagataagtcatttaaaggtgtagatgggaaaaaaatcatttacgttcaagcctgcagagggtggaatatttacccatgcaacacatggctcgagtgatagcatgacacacgaccacgattttcttttgagcccaggcacctttaaagtgataagcctcgtcgaaaacctgaatataatcgcacggtagtataccccgatggatatgctgctcgcaggtttcacaattccagtcaacttttaagtttgaagtacgccttctagactgaggcaaatatgtgccagaaaaatgagagtcgtactgcaccaggcataccccccacaaaaaaaagatattgattttaagacagtgaggatgtgacctccgcatccacttg

SEQ ID NO: 7640 - DNA, 700 bp, Nannochloropsis_gaditana
cgccacggagagaaagaaagaagcagagacgatctagatcggagtacacgtggaagatgggagcaggttgagaaaaaaaggacaacagaaagtggatcaatgtcccgacccgcgagatcgcgtgggcgacgacgcgacgctcaggctcgccacagggatgagcgcaaccaccaggacgaggaaatgttcgacggactcgacgcaaacccaggcgtggacgggaggggaagcacagtggcagcctggcggtctcataaaaaggcatgtgcaggtatttctacacggacagcacgccccctcccttcggcgcgggcagcaggacgtaagagacgtcgttccactcttccgttgaagccttcgtcatcactacagtggcctcggtattcaccggccaaacgtcgcaaggacgggaagcttcctccgcgaaggccccccgcctccccttcctcaagcccttccccgtccttccccccttcccctccctccacctcctctgcctatgcctttcgcacgctctccaggccattaaagcccacgccacgacagcgtccctcccctcccccgtccctcccttcctcccctccctccttcttcccccttcccccccacttccgggaccgagggcgggtccttttccgggagttcaaagccgcgctctcctcggaactggaaggggaggtcgtcaaggccacgcgcccag

SEQ ID NO: 7641 - DNA, 700 bp, Nannochloropsis_gaditana
ccctcaaaaccgctcgggcagggcagcatcagaatattcatgccaaattaatgcatttccgacgactgggtccaaaccatccatcacacgaccccttaatttcatagaaggcccccagcaacatgacgggattgaaaagtcaaggcaccgggacagttgtgaaagtcagaaaatagatttgagagaaaaagcaaaagataattccgacgcctctacggcatccgggaagactgcgcaaacgccaaaaattcaccgggccaacctaaaacggcacgtccaccagcctaagcacgtgcctttatgccattgagagacacgtgcctttgttttaccgggcccgacggcgaattacctagtcatcaaaatcgtgccggcgcgcctcgtacggctggagcctgaggaatgcggcgacgtggtcctaggcgcagttaatccctttattctacgccttaccgtcaacacagagtgtcttcgcggctctgcccctcgtcccgggcgtgagagaagcatgctggttgtcaactttgaggccaggggggatgaagttcagtcggatttgcttttgcgttggaggcttgtggtgtaaatgttgcgcgagggatcttttttagtgacggtttgactccttccgtgctatgtaccgtgcgcttgtgttattctcccttcacatgttttccaacattccctttcacttctgaac

SEQ ID NO: 7642 - DNA, 700 bp, Nannochloropsis_gaditana
gaagcagcggaaagcttgaagttgcgcgtggaaagatgtgaagaattgtagtgaggaacgggaatgaatggaagaagggaatgcaaatgcgaacttcacaaccccgctcagagtcggtggatgttatgtttgacctgaatggatcaagcaaagaaataacatgcgcagacatcaaacactcgaagcacgggagcgagcaaaatgttccgttaattacgcttgctgacgggatcgggaggttggacgtctagggccatagccagacatagaaaaaatactggtccgcgtttaaatatgagagtctacggacattcagacaatattatcatttcgctgcagagcatggtatggttggtgcggcagatgctagcaacgcctcgagtcgtaggtctcaagtctgagcaatatgggccgaaacctgagagcacgctcgatcttgtgatgacgccgtgaccggctgccacaaaagcgtccaggatggtgacgtggtgccgtgttccatagacagtatgtaatatgacgtgatatttcaacttctgttatcaatttgcgctgaacggtcctattttgtgtcttgttcattgtaatcaatgttagctgccttgcacacgcacgcgcccatcatatcctccagccctcttcaataaagggcaacgatactgattcctcattgacgacacacacaaatcgatagattatg

SEQ ID NO: 7643 - DNA, 700 bp, Nannochloropsis_gaditana
gttataggaggcgtacgatgtacgtaggggcctcgctcttatgtgtcgatgaaagtgtggagtgagcgttgtcagaacacggagagacacttggggcgtcctgtcctgaaataaaaatgaaaactgattgcaaaccatgtttgtgtcattctccttcctcttgtacatcattctaatggcttttattctagacaatttgtaaacgcgttcatggctatcaaaaaccatctgacggtgagcttggagccaggacggtacgacgtcccaacgaacacgtccgcaaatgcataagcctcctaaatcccgttactgtgacatagcgtagaaaggcaatcatattggatcacacctcgacggcgatgggaatggacattagggactgtgtggtcgtgtatggagattccggacagttactagtacccggaggatggaggcttccatatcgagtcctcggtgccttggtggcagtgtcccgcactgcgtgatcactggctttctctcgactaattaatgcctgtacgcgcgcacatttgtcattaagcgtgtccgagggagtcaatgtgcgaccatctggcctttaacgcggtaaattggcttgcatttttggtttcttccagatgctaagctactgggaagcctgaatacataaggctcagctctgatttacatttgcgtttcctttctcaaccttgattcagtc

SEQ ID NO: 7644 - DNA, 700 bp, Nannochloropsis_gaditana
acgcacaggaaagaaaaatccaggagcacgggctcgccacactaggagccatggctttgcggagtccggacaactgccgccacctatttggaatgggcgccgtgtcggtaatcttggaggccctggaacggcatccagaggcccgtgcaatacagcgtcaaggctgtttggctgtgcggaacatggtcagccgtgtccctgagctaggggaggctttcctcgaggcgggcgcagagcccttattgcggttagcgggacgataccaggaaagcgtcgatgaagcgtacgctgctttgcgagacctgaagtgtgacgtgaaacgtgtgatcgtggatcccttgacgggcgaaatcaaggctccagaagagttcggcagcgccaaaacttccttccggccactttttgatagcagcaacgacatcgaaggggcggtgcaagccgcaatcaatgcccctagtaattcctatcgtttttaaacgcgaaaataagtaaaaaatcactacctacaatgtccatcgcaccgccgcacgcgtggtctcgcatggccttgttttggatgctgggtcactgtgatggagggcaatccagcgcgtcttgttcgccgaccgtctggactcggtgcgattgtcacgtcctatttcacctgtttcacttgccccgcacaagcaaatctgcccctaacttttattcccttcctcag

SEQ ID NO: 7645 - DNA, 700 bp, Nannochloropsis_gaditana
caaaaaaggcgagcgcacgcatcagcaacctggagcagtaagtcaggatggtgtagaaaaaagcggacccgaatcatcgtcatgatggatgttattttaattagttgtgaaccaggagtgagcgagggcagggggtgcacttgatcccccgtgttccttgcccctggtaggatgagggaagacgcgagggcagaagtggtagaagtggatccaaaacgagagggagaaggccacacatatagtagctgaacctttgttccgcttcctctagacacgttgggtgtactgggcgccgtgtgcacgtgccccaatgcctgtgcggggtcgaccgcgtggccaaggcagtgtgtggttgaagctgttgcagagggcaagatacgcttgaggaaaaggcgctggtggcaaaattaatccgcagtaggcgaagaggaggagaggatgctttccgcctcccgtcactcgttggtggcctcttttctcttgtggccttgcctcctctcttcctcctcctgtgtgcgttatggcaccgtgtcctttttctctttaattcactaccacccacttcgaaagcgatgcgtcctcaccaacaattactcggggcactcccgtgcaagacgccttcctcgcattgcgggaagctctccgtggttgctcgcacaaaatcctcaccctttctcttgcttcctttcccgtaaaatgg

SEQ ID NO: 7646 - DNA, 207 bp, Nannochloropsis_gaditana
ggggggcgggggggtggacggagagatagcggctctccggtcaggggtgggcgtggtcaaataagccacgcgtttacggttcgctggagagcgacggggctgggcgggtccgacgtgaaagatgacagcagcaggcctccatataatgcccctctcttccaaaaactggaggcgctagctgctaagacgcgacaagaaatagcgatg

SEQ ID NO: 7647 - DNA, 700 bp, Nannochloropsis_gaditana; identical to SEQ ID NO: 4685

SEQ ID NO: 7648 - DNA, 700 bp, Nannochloropsis_gaditana
gtcagccttggcatcacattataaattttattactttgggggccttattcgtaaagcctggtgctttttcgatcatcacaacagaggaaaaggtaataagcaggaaaactcacaacttcaggggggtgcagggtgcacgagagtatctcattgctaacctacgctctctgaagtcatttccttcactggctgtatatgtcccaaaaacatctcaatgatgggttagatggaaaaataaccctaaaatgtgcataatacccacagtcttaaggacattccagctgggaacgcggaccaacggctcggaactttggcgccaagttcgctaattccgagaccacgccggcttgcgtgcgtgtcagagttttccaaccttcgtcagcgtccaagcctttgccacaccggagcgggagggcttcctctgccaaagcgataatccatgcatgagtaatgggatttggtgtacaatcaaacatttcaatcctcggtaacgatattctgcccctattttctccttcaggacgcgatcattgcggtatttgttttagagctcttagacctcgaatacgctgcaaatacagagtaatttgtaatctttcgcgcaacaattgggaatcctgcaaaaaatatgatatcatctatggttttcctgctcgtggtattggccatggatcccgcatgtggcttcctctcccccatg

SEQ ID NO: 7649 - DNA, 700 bp, Nannochloropsis_gaditana
cattcatttgaagtggagcggcccgtagacagcaatggggacaaaggtaagttttccgccgtggccaaaaagtcctatgtccgggaaaagagggtgccttcgttcccagtatgcagtgttacgtcatatgtatctcacgtacactcattacaggaggcttgcccataacaatttctcatttgatttggtggtgaggtttttcaaggggcaaaggacagcgcgaagcaagaccacaaggttttgtaagggcaaaagatggtgactcctggttagctttgaaaatgcttgagcagcatgctgaagtgtcgataaattcgtaaaatgtagttctgtcggcgctcgtccttctctaggtacttcttcaggtcgttgttgaggtagtttttcttctttggcgtcgggcgcagcacgtgcttaagggcaatccacagcgtcatcagcttcaaagtcccccctcaagtgcttccgaagactttggaccttgcccggctcttacataccctgcttgctgcacaagatctacaggaaaaagtattgttggtcagaagacggaagaattgaagttgataacgttatcagggcttcatagcccgtaatcagatcgaatctgggcggcacagactgggccgtgcctctatgactacagcctacgccggagccgccctgcggtgggcttttcaaacgctagatttgcgaaatg

SEQ ID NO: 7650 - DNA, 700 bp, Nannochloropsis_gaditana
ccccgttccggcacaaaaggggtatacgcaagagcagacgggacccaaaaacgtgccaacgtactgcaatgatggagaggacgacagaagacggttataaagatgccgggctgcattgtgattatgccagggtgcgcggcacgctgcaggagcgaagcggaccatggttgacgctctggttgtgagagtgattttagtttaagcaacgaaaagcagccacgtcctagggcgcgagagccaccaacttcctatcgtgggccctgtactacgttgggtgtacatgaatcagagatggaatgccgttgttaaaggacgcttctcctcaatcgttcattgtgtccgtctcgccttaaagccaagtgccgcgtcgaagactcgctcagccaggcagccgccgccacccaccccctcaacctatccacgcccccacgttatctctgttcaaagccacactatgccggctcaggcgtccaccataactcagccgcctccatacctggtttttgacatagaccggagatctcgtcccactcgacaaatgatgcgacaagtagccctcctggcggtcgccctctgcgccacctcctccctggctttcctgaccccgcccccccggcctgtgcgctcgagatgcggcgtccgcgaccgggtattgcagatgtcaggagttgaacgcaatcccaatttcggcaaattgatg

SEQ ID NO: 7651 - DNA, 700 bp, Nannochloropsis_gaditana
atgtattctgttccgacttcttgggtcgcagggtcaatccttacatttgtgtcctggatgatatttctttttaacaggctctgaggatgtgttgccaacaaaatatcacatagctaattcatttagtcttttaagtgtacaaatcttgtgtctatctttggtctaagtttaaggtaatgctgggtcttcaagttctaggcaatgtttcctcttgcgtctcttttagcaccagctctggtgtgaagtaattaatggttttttatcttacgcttacgcaacagggatgttcttgcagcatgattatcggagatggaaagtggtgcttctaaaattcatcggtctagtgcaattcgttagatcgcgacaactcctgcgaactaatgacactgctactccgcgtatcaacaatagctttatcgtcactcacagcaaagaacgaaaattttcagattccccacatgttcttcatatttcgagcgtcgctggaccaggactagaaaacaggcttcttggcgtaccattgggtggtgagagtatctcattcttccctctcgtacaaatcgtccttgatccacgaagggtgcaagatcgatctcccagcagacacaagctattcccttcttgtggattcgcagagcctattattgatgccccagggtattgccctctggtgcgcatacttgagagaggcgcagatatg

SEQ ID NO: 7652 - DNA, 700 bp, Nannochloropsis_gaditana
gagcctacataccctgcaccgcctccctcccacctaccagggtcccaaaccgagcattttgcgagatcgtaaggaatattcggtcactgaaattgaaaatggtaacatctgtgaggacgccgttaatctcctgatagaacgtaagacagggagggggtagctcagaagggggtccgccggcgtgggggggtggggaggtagaacacgtggtaccttggtttcgtggtaggtggaggcctcagggggtcccgacgaggatgccctcatcgcagggctcgtatggactgccagcctgtgccgaaagggagtggatggatgcaaactggtgttcgacggcaagtaaaattgagtagcgtggctgtcctggcgagcagcgatgaccaagccggcgtggtggctggatctctcttgtgctgccaccctttttacgtgtatacggtaacacattgcaagataaccggttcataacgtcaaaaatatattgcacaagaaaatgaaatttaacatgagagttctgacggtctaatcttctcaattttcgtcttgcctgggcggtgcatggcacgcgttatacccaccaaaagtggttcaagtaacctcatgtaccctggacgcgtctttttcaaacccttacagcttcagcaaggccatgggttggacacggagaagaatagatcactcttgttattctgttcctatg

SEQ ID NO: 7653 - DNA, 700 bp, Nannochloropsis_gaditana
atcaaagtcatctcttgtcgaggctagactgggtcacataatggcactcccaacatgtagcggacttcacatacctcaacacttcgccgcctaagacgttttcgcgtgtgcgtccaccgccggtccgggcagtcgtgtcccactgcggcagctgcttcatcctggtcatcataatccgcatgcgatggaaagcaggcaaacgtccttcgaagttgcagcatatgaggcgaaatccaacgtgatgtcgatttctacgttctttcgcttttgcccttgcttttcagatcctatgatgaaatgttccacagaagtataaatgggtaaaaataaatttaaaaaaagctgtgtggctgcatatggattaacctcttccaaaaaagagatgttgagggaggcttgcgtttcctgcttctacgattgccgctcatggaacagcctgccggaggcgaaggggtcgcaatccatcatggaaaagcgtcatcatctcggtcggaccgatccccacagggttgcaatccatcatatggaggcgtcatcgccggattgggcaaggtggtagttgccttcgaggcccgtgcatgggccatgggcctcagacttgctacacggtggcttccacattcacgttgagaccgcgtcattgctcactctgacagattctaggcacagtctgccacattagccctgtccatcgacaatg

SEQ ID NO: 7654 - DNA, 700 bp, Nannochloropsis_gaditana
ttgtattattcccccctctttctgatccactatttccggctgtcggtcttcaagagtttcgggctgcgtttacttcaacgcaaactgcactttgattatgcatcttgagttaccatgtaggtacaccacacttacctgttttacgcatgcttggattagattcttcttcttctgtaagaagaacgaacggaactcactgatgaggctagaaactattcttgcgtgccactattttatggacatggtccgagctttgctgatccacgtttgttatctgggatacgacatgctctgaacaataaccccaaaacgctctcaatgtcaatccaaggggcaaggtagccaattgtgctggacgatcactgacaaccagttatgtaccaattaccctttcaagcattgtgtcaaaaaatttcttctttaatgttattcgttgctgttctacgatagtcgggcagtggcggtatattgatccgattgactggacattcgccgttgcattggcaaggccacactgcctctacctggccaataagaatacctatgatgaatgcacaggatcgtgggctgggacctttgcctccgcgaatatgctgatagttttacttacaccccacctcttgtatacctaccctcactcatgactagattcgctccgaacggctcacacgactctgcccggcattcagcaagcctcatg

SEQ ID NO: 7655 - DNA, 467 bp, Nannochloropsis_gaditana
ccctccctcccttccttcctccctccgcccctacagacgtggacaacgcccgcccctcatgtcggaagagtccatgcccttggatacgcgcttcaacgaggtggagggaggccaagacttatacccggatgagaagggggtgtggaatctggtggaggagggggagatgaaggtgaggggaggaaggagggaggcggaggaggtcccgcggggatactgaccgcatcgatggcgcattggaacggtgcacttgaaatgaatatcgatgataaacaactccattatcgatggcaaacaaagtcaacgttgatggcaaacaaagtcaacattgatggcaaacaaaataaatccaacagtaatggcgaaaatctttgtgatggcaaacagagtcaccatcaatattgaacaaagtcaacagtaatgacaaacagctcttccccctgaaacaggtgcaagcggcgcccatg

SEQ ID NO: 7656 - DNA, 700 bp, Nannochloropsis_gaditana
cagccaacgaaaatgtccgacaataaagccaagtgacggatctacacatccacccaaccaaggccatggcctcgtgggctttccttcttgtcgcacctaacggacataatctgcttgcaaaatctctcatcctttggctggaaaaccagtcgctcagatatccatcgagttgcccttgatcctatgatctccggcacattgcgacaccccccgtggcttgcacgtccgaacgcccgacctttcacgcaccacatgaatacgtagcgttgagtttcagaaaacgggatggggacgtggaagggccgatttttggcattttgtgggcgcactaggacatgagtcaagtatcctggggcagggaggaagatcgaggagagcaacctaccgggcaatcgtctcgacacgatagacgggcatggtcgatgccgagggagtgtggggtcggcttcgttgaatattaaacagcagaatattaagctacatatgcttgtgaatcccttattgccgtctgccgtgtagtcgttggtgtcggcttcgggcttgacggctaaaaaatgctgcaagcaacgtacagcagaagcagcagcagcaattctccctacagggaaaaaaacaatttgactcagtccccctcttaacctacgcattctcttctcttctgatccttgtaatcttatacaccgaccagtacgaaggaatg

SEQ ID NO: 7657 - DNA, 700 bp, Nannochloropsis_gaditana; identical to SEQ ID NO: 5597

SEQ ID NO: 7658 - DNA, 700 bp, Nannochloropsis_gaditana; identical to SEQ ID NO: 5593

SEQ ID NO: 7659 - DNA, 700 bp, Nannochloropsis_gaditana
ataagctttgagggtgctccgaaatttgtgtgcctgggcagccaaaaatcaacgcataagtttttcattatgtgcgagattggaatcccacgtacctcaatgcatgctgccgataactcgatcaaatcaacgtcttctgccggctccaagcctgttcgccaaggtcgctctttcaaggcctccgcgatgtcttctggcggtgacggggccgtggacaatgtactagccaagatggaggaggaagcagatcctatgcctgagaggtaatacttatggaaggtccctggtaatatactcggatgcgacgttttgtgtgtgatagatcttgaaaacacagagaaatgacaagtgttccatgaagaaaggcgtgcaaaagcaatgccagaccccacgggaggaggtaaagccagcgtggccccggcagaaaggaagagccagggagggagtgaatgtaatgaaaacccccacgggcgtgcttgacgtcttggtggcattaagtatctgctgcacgaaaggttgggtctcctaggggatggaatggggtgtgaggtcgtgagcatgtgtttcgtgtgattcttgaaggaggttagcgagaaaagcgaggagtcggcgaccccctgacaggcaggcccttaaaaacactaacaccacgcctattacagagcgggaaatggaagagtaaatcggtttttgtgtcatg

SEQ ID NO: 7660 - DNA, 700 bp, Nannochloropsis_gaditana
caactccttcaaacaaaaggtcgtggctatatgacacgtttggtttcccagctagcagcagaagtgaaattctagcgtcatttcaatacttgatgctacagctgggacgcaaacttatacatttcaaatcaaaacgacgggggtataagaggaacgtatcatttcgtgtccgaagtcgctctggagaaggagcgagctgaaatatcttggactaccatgtcaccccgacgccaagacaaatgcatggcccggtgtcggggccttgcccatggtgttttggaagtgatagtgcctcttgtgacggggcatgcggcgcttgtgccccgtgggcttgaaaagaacataatctgcctcttaaacatagtcatgagccggcccgcgagccgcggcagatctgtcacaggacacgtctatgcaaagcccgctcactgctcacgatttgatgcctcacatgcatcggccactgctcaaacgcatcctttcaggagctttgagcgacctggagcgttattttgtgcattttctcgtctgtttgtgttacttttccccttttcactttcgttgtcctctctgtcacaggacgagggtccctattccctcaagtgcaagaagaagccttgaacgccacaagtaaccgtgacagcagtctcaccggcaactacggctctacaatatatttatctggcatacagagaggatg

SEQ ID NO: 7661 - DNA, 700 bp, Nannochloropsis_gaditana
cattgtgtacgcacgaaaagagctcacgtttcgtaatgtcataagcgttgtttaaaaggacaggatgtacatatgatttagcggtcaagttgaaaataagcacacggtcttctgaaagcgaggtgaaaaaagcaaaaaaagcaaaaaaagcagaaaaagcagaaaagctagaaaccgaattgaacaagtagcgaattttcctggtgaatctaggccttcatttctccttcttattactgcgtgcattttttatttgtcttttcttgtatacgagatagaagcataaaatgttcgtttaaaacattttagatggaaaaccttgaagtctcccgccagtactggcccatacaatgcatcaaaacgcatgttcacttaataattagtcgttgctcaaacaagtcttagctctccatggcatagcgtatactcatacgacctcgaaacttgttctgtttagtcacccatcatctctgtatgaacggagatgcaacatgtatatctatattttttctgagacaattccctctgcagctcttctgctctcctcttttgagggatgaccgacattcagggatgttcatgtgaaggaagtgtcgtcgcgtatgtggaagacaatcaacactgaagcactctcatccatagtaaacaattttcagcacagtatacaatatacagctcatttttcaacatcttcaccatg

SEQ ID NO: 7662 - DNA, 700 bp, Nannochloropsis_gaditana
cgagcggcagtgggcgaggctctgggtcgaaagagaaagctagcacgacacgcgacgctttgacgcggccacaagcacgcaaatgctcccactaaggatacatgtgtagcctctgcacgtgtagatccaccgttctcattcgtaacgggtggcgtgccaggtggtaagcgcacaaatgtctttggcaaagagggtgagacgatgagaacatgatgatgtggcctttcttgtgcttcaagctgaagacgaagtggcttcacttacagccttcttctagccgtgaccacgaactgcttgggtgttacaacgtctcccgaattgcaaagtggcacagggggaacgcgatgcgttgcattggcctttaaaggatctgataataccgtcattagatatactttcgtatccccgaaagggttacagggtttctgcgcagtggaccgagaccactaccttgacgggatcgtgtgcatcaaagtatacgcgcataacaagagatagagtattgttggcgttctagcacgtctagatcactgcgcttctcatattgggctgtacagacgtgggtgaaggcctccaaggctctcccttgcacgtcatatttctggtctcctttcactttctcgcggcatcctgccacacgattatctggctcaagcctgtaattctcataagactgcttatactgacgaaaataacaatg

SEQ ID NO: 7663 - DNA, 700 bp, Nannochloropsis_gaditana; identical to SEQ ID NO: 4546

SEQ ID NO: 7664 - DNA, 700 bp, Nannochloropsis_gaditana
taaggaaactttgggagagaggtggggggtaagatacgattaaaatagttgtagttggagggatggaacctggagggttctcaataggaacaaaaatgaatgaaagcggggtcgcagccccactgcactggccccccacccgcctgaaagcatgaggtgagatacccacagagaaaacatcgggtgtcatcacgagctcaagtgtctgcatttgggtggagcatgctcggcagcaggccccggaggaggaaagtggtatgacaggtcgctggggtggaacaatcccaagatgcagcttctcctctgacgcagacgccggcgcccgcgccgcgccccgccgtcgtcccaagtgctacccgaatccaaatacccagagagctccacgcaacggccccatgcacagcacgtgcacgcgaccatcaccccgtgggtcgccgtggtccctcatgcgtgcgtgcgggggattcactatggctgaaactttcaaaagagacgtaacggtcctgagatatgatgactcggacctaggcctttcgctgccttgcccttcacccctgtgtcgcgacaccccccgcgggtggccagccccccatttgcagaacgcgcactcgcaaaggtcccatgttaggtgccacgcggcataattttccgcacgctactttcctttcatttcttggtgcacaggcgaaacacgaaaatg

SEQ ID NO: 7665 - DNA, 700 bp, Nannochloropsis_gaditana
agggcaaaaagcatccctctttcggctccacctggggggggagcgccctaccctctatgaaatgcatgaagttgtagctcgcgtctgcagagcgtacaaacaacgcacacagttgccttagatctctcacaagtttcggaagagaagcacaactcctcagaaagacaatgcatcattcaaatggaaatgcggtctggcaacctgttccgctataaaggtcccaaccaagactaatcgttccatggttgcaagaagttgatgaatgcaatgtatccacgggcatagcaagccaaaacaggaatgggggcaaccagaggcctcacctctggccaagcattgatttgtgtattcattctaacacagccgaggaggatctgtgcccgtaggcgcccgcatcttacgcctggctaacgaagcccgaggggaatgctctcttcaagaactgcctcctcggcagagggctcgtcccgatgagtgatgatgtttctcggcagagggcacctcccgatgaatgatggtgtttctcctcccccctcagagcctgccctttccgattacaagatgaacatttcccccacaagaagcggaaaacatgacgttggacgcgatgattcaccgcccttatacctgtttctttttggaaaaagacagggaggcctgttcgctatctctcgtggccggtctgacctaactcgtcatg

SEQ ID NO: 7666 - DNA, 700 bp, Nannochloropsis_gaditana
ctccgtcactgcatctaggtacgccgtgaccttgcgaaaaagcatttggaaggccggctgcaacgtagtattatgaatgataccgcctgtacgaaggacaagacgatgcaatgtgaggatgagtggctccgatacaaattattcatgtctgcgcatggactgagcccggttctgtggccctattaccgagttttggacctctgtacagtattacgtatcaggtactgcgggagggcttgagcgaagcagcgtttcggagaacaccccggaagtgcttcaactcggttcccacagtctttttatcttcacagtggatcccgaataagtgtcctaaggccacaataagtatcaagatatttatcacctcttttttcttcattatctgctaaaacagacctcgccagggggtcaaagtagctcgcaaatatcctccagcgccatgggagtatccatattacctttcacgtcaaaagtttcctgtcttgtgattttagtcttgctcttgtctctggtagatggtttcctactccctgtgcaaatatcatttgacttgcgctcatctgtaccagagcataggcgccggcctgcgtatcgagagataggtctcgccgcggtcgacagccagcccccatcagctccctcgccggcgcaaacacaagcagaagaaagcgatgtggacgagattatagacgctgcaatg

SEQ ID NO: 7667 - DNA, 700 bp, Nannochloropsis_gaditana; identical to SEQ ID NO: 5851

SEQ ID NO: 7668 - DNA, 700 bp, Nannochloropsis_gaditana; identical to SEQ ID NO: 5485

SEQ ID NO: 7669 - DNA, 700 bp, Nannochloropsis_gaditana
aaaaacacacataaggacaagcgatttgggagtaccgggcacaagttttccgccaacaatccttacggaaggcgcgaagcgggggactcgcgacagttcacgcgatgaaacacgtgcagagggcgaacatctcgaggagaggggcgcgccggcggagggataggacgcgatggattacgtcgtgggacgtaattttagggaaaaagaaccaatagactgaacatcacgtttccctcatctctttttgttgtatttctcgaagtattaaacgcaatctacatcactcaaaaaacctccccaccctctccgggtgtctggagcgaacacgctccaggccctctttcacgctcgctggccacccaccgccttatcacatttctgaatatgatgcgattcctgaaagtgaaagcactcactgtagcatcatttttttgtgttcacagcattttgcacggcttcattaaaccggcggtccatggacgaatcggcgcgggcgtcgccacggaggtcataggcccttggtgccgcctctcgagaggggagcgcacaagccacaattttctcagcctctcccaatattgaaattatcatctgggcagttgtacatttatattgaactcgggacggagaggccgcaggttccgtcgtaaaaagcagcgcttggccaaggcgctctacaacgaagccttcacacaccatg

SEQ ID NO: 7670 - DNA, 700 bp, Nannochloropsis_gaditana
  misc_feature (1)..(361): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaggaggaggaggaagtcgaagtcgatcaagaaggaagagaggcaggggaggctgaagataatggttatgatgagcagcgctcccgtgtaaataccaaacgcaagcatctaccctcatcctccgaggccaagaaggtgaggaagggcgtggacgaaaaaagtggaacggcattgcccgaaacgccgcgtccggaagcgggctctggggaagggaagggcagtgggggcggggcgggaaaaagcggggccgtgttctttgccaaccagccctttgaggacctgccaatatcggacgcgaccaaatgcgccctcaagaggctccggttcgtgaagatg

SEQ ID NO: 7671 - DNA, 700 bp, Nannochloropsis_gaditana; identical to SEQ ID NO: 4760

SEQ ID NO: 7672 - DNA, 700 bp, Nannochloropsis_gaditana; identical to SEQ ID NO: 4761

SEQ ID NO: 7673 - DNA, 700 bp, Nannochloropsis_gaditana
ccccaagctgaactccctcggctgccatgagtcgccgttgtggacagctcagacttctgcgatcaacttgcgatgagacactcaccacagctaaaaggctatgtatcatgcaatgatccaaacgcacgacgtgtgtcgatgcgatgcccagaatattattcaaacccctcagttcggcattgaggtcgccgttacttgacgttaggttccgttggaattcaaacaaatttcacgagagaaataaaccatttggttctgggtcccgggagaggagcccccgtgaaattgcatggtgtccagattccttaaacggtttgtttttgtctactatcatgctaaagctttcaattgcgcaattgcctgaagtccgcggatacttggacttcatgagtcgtcttggaccgggttaagcacacgtacatttctgtttcctgacccggctcgggacatcaaatgggccatgacccgaagacatgccgagcggccctgatctctataggtgtttagatgcttgcaaacaatttaaaatcacacaaactcatttgtatccgcaaaagacacctaagaaaaatcatttttgcggcgcaaatcgtacatccaccacggtattcatttaatacgcgcggtatttagaggagaccgcgcagaacctaacgaatcacaacaaacaaaagtattttgacagctctgttgctctatg

SEQ ID NO: 7674 - DNA, 29 bp, Nannochloropsis_gaditana
gtgacgtgccgttctgcgacgtgaaggtt

SEQ ID NO: 7675 - DNA, 700 bp, Nannochloropsis_gaditana
tgttctacgcaatagtacaaggcacacacatagcatgctggcggaaatccgtgcaagcggcttcgagtggaaggacaatgaaatcatgcattttttgggggctatctctgcactacattgtacaccgcctcttgcacgcatcgatgaactctttagacaactgtacgttttgcctgtggcgcgtgctacacagatataatgtataatgcacacatttgccgagttccgcgcaacacctccacttcatcgctctccgtctccccttctacaccctacacagggatggaaagcctccaccgccctgccgagagtcatcgatgggggggtaagaggggtaaagggcccttccataaaggggcaggaggtcgtacccggagatctcgccgaggccggtttgaaacggctcaaagggctctgctatgctccaacatgacaaacccaaggtgttgggggcactgagcgcttgcgagggcggtgtctgctgaaggaacatccagtcgggctttttttggtgactgtacggagtatgcagtaggcaattctgagaaggtctgcgccctggaatgctgaaaatggtcgaagcgaaagccgacatccttcgtacatgtcagccctttttttccattctcacgctctcactcccgtaagcagataaaaattgattacgatctcctgggatattttctaaagcctgtgcatg

SEQ ID NO: 7676 - DNA, 700 bp, Nannochloropsis_gaditana
  misc_feature (1)..(573): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccccccttcccctcccccgtctccccacagtaccaagagtacctctctctccgccacgccttccgacagcggcccgaccccgccaattataccattatggttcaccatatacctggctccatg

SEQ ID NO: 7677 - DNA, 700 bp, Nannochloropsis_gaditana
aattcaaacggcgtcgtcatcttttcctgagcctgagcattcatgagtcgcaacaattcagcaatgcaagtcgcggtacctcctcgtaagcatgcttattctctcaaggttaccgatgcagtcagtagatgatcctcgcttgcctggttgtgctggggggaacacctacgatgtgcttcccatgccctatcaagtgggcgggcacaagcctaaagatgccagtgatcctccttacatgttgcgcctgcaaccacgcgtcgcaccccattgctcgaatccttcctccacatcctcaaacgatgcgacccagcctcctcgacttctcaaagtgatccaagcaggggacaagggagcgcgagaagcagctttctatcacaagcttttcggacaggacggcatggatggtttgaaggaagatgaaataaatgtttggcgctccctacgtccctttgtcccgtgttattacggcgtcctgacacgttccgatccgacgggcaatcctcgtcgctaccttgttttggaagatatatcagcacctcccaatccgggggtgaatgatggcttctgtcattgtccgacaatcttggacatcaaaattggtcttcggacatacgctccctgggctacattgcagaagcaaaagcgagagagagataaatacatgcaccaagaagctgtcgggtttcggattgtgggcatg

SEQ ID NO: 7678 - DNA, 700 bp, Nannochloropsis_gaditana
gggcgcgagacggtgacaattcgcacggcctgcccccctgctgctcactggagccacgctctggttctatgagactcggagtcgcgtgtggatggtcagatggcttgagtggcgcagcatgctgcatttcctgcgtaattctgtttttttgagccggcctgagtcatcttgagagcggagacacgcatgtgacggaagggcttgatcgtgccagagccctaagccgcgctttctctattgccacgccctcttctcattccacattcttccgcaccaaaagtagacagagaccaagggataacaaatctgtttgtggctcgatctgcccgtgcgaggtgaccgtgaggccgccaccgtgctgtcaagccaccaccagcagcgcaccgcctccgcccaccctccttgtcaaattatatactttccgcgtaaatattagatagtactgcctatcatgtctactagcctaatgacacccagccgggggaagaaaagaagagccccgcagaccctgagcagctgtaagctcgcagcggcggctgtggggttgttgtgtcttgcatgcccgcaaggaactttaggtttcgttccgggatcagtgaagcctctagagaccattccggcttcaagagcgtattttttgtcctcgcctcacatgcctgggtttggaaggcggcaccagccttgtttggctggcaagatg

SEQ ID NO: 7679 - DNA, 700 bp, Nannochloropsis_gaditana
gtcacaacacgaagccagaagttataactggagtcaagactatgactgtcaagatgtccattccatgcctcaagcacacataaacgaagactttcatcacagaagcgcgaaggcaagcgtgattgaagcgcgctgctatatgacgtatatgtagtgactttaaaaaaaaaagacattcgcttcgtaagtgctgctgttttgcttgatcaaaagtgcacatgaggactttgatgtcgtatctgatgcatgcgcatcgaaattccgggtgaacatgcttgctcgatgtacataacattgttttattcgctccagcaaggatctcatcaggagaactccggcatccgtattcgatgacctccccccttcacgcggtcgatgcttcgcatgacgctgcatgggatgtcacgtatggcaagcatgaatggacgaggcttgatggcggtaaggattcctttctgaaagcctggaaatagaggacatgtagcaattatccaatttggagccgaatcgaggctgcacgccttgagccctctttctctcatgcttgcagatcctttttgcttgccaatgatcgacgggcgggaaggagggcacgaaatcaaatgccacttggcgcacgagtggcgattgcatgggcatgaagtcatttgtacgcggggatgaaggggttgcatggtgaaaaaatgacaggtgatcgatg

SEQ ID NO: 7680 - DNA, 700 bp, Nannochloropsis_gaditana
  misc_feature (1)..(10): n is a, c, g, or t
nnnnnnnnnnggggggggtctgaggaggcaccgtgagggcatcgcgatcaagcaattgcatggttgccacgcatgcaggtctggcttcgagcatcttacctgttccgcacgcttgctgaaacgcaatcgtccctcccttgagccatctctgtaatcagggtccgggacaatggtaggaggagtgcccgcgctcatgacgtatgtctgagagatgcggagaggttgctgtgagcattaaggctgaattatgagcagcacatgacgaagcccccgaaatatttgagttgttggtgagatatgcattgcatggcaatatgtgcattgagtcccacgccttcactgagggcgaccgtagcaaaaaggaggcgtttctagggtttcagccacctccactgccagacgggcactactctccctgtacccccccgcctgtctgcctgcccccagaaccagcgtcaacaaatcttatttcaagcgcagtcctcattacaggcatcacaacagcctcgttcaccagcgctttggaggtgaacccttcggtgacaaattttggctgaaacccgacgcggcgggaggggttcccacacgcagggcttgcgggttcagatatatattgcggcgcacaagaaagcaggcatcattcgctctggtagcagctttgttggttgaggattgttgaatacacatcattacccacatg

SEQ ID NO: 7681 - DNA, 346 bp, Nannochloropsis_gaditana
tgaaccttgaggtaggggggggggggagaaggagaagaacgaaagagaatgagggttggggttggtgaaatttgtagcatagcaagaaagtagatgccctgagtcattttcacgtaggctgcagacggcctggtggtctgttgtgtgggaaaaaaatcatttctttgactgtcgacgatgtaaaaaagaagggggggaattgaggctagggttgaaattgcctgtgccaaaggaacccgtggggacgtggggtgatagcgttcaattagatagctagaaaaattaagtggacaggggttggggggatgtttggagggcatcaagagactggaatgtggctgccatg

SEQ ID NO: 7682 - DNA, 700 bp, Nannochloropsis_gaditana
ctgttctaaagtgatatactcgtttagcttggtacagctaggtgcactgccattcctgtcgtcgaaattgtccgaggcttgaggcacagtcgaagtcaggggcctcacagcttgacgaaataagctccctgacatttttatgaagtcaaatcccatgaggtttcctcgtggtctggtagcttttttgttgttgtagagaaagcagccactagtgaggcccaatttagatgtggatatttatgctacttcagctgacatgcatggacccacttcgcgtgcactgcgtctacaggacgagcgagcagagacatgtgtaccaaacgaaacagtcatgcaaggcgctagggcagcatctggcctctgtgtccgtcattcagggcgcgggcgccgggcaagggacggaggcccccgggcttgaacttctccgggcttcgcggactcctctcccctgcctgacatgggccggtccccaggggcacctaggcatgcctcccaattcaggccactgtgtcttggcgcccgcatgctggctccttgcgggaaaaccttggatggaatgtcgtagagcgtctttatttaatcatttcccatattctttctctcccgtttattcttcatcctgtcagggatcaatcctcctagatctccctagctttagccctcaggtcctccccgacctgcaaattttctgtgcagcatg

SEQ ID NO: 7683 - DNA, 700 bp, Nannochloropsis_gaditana
  misc_feature (557)..(566): n is a, c, g, or t
tgaagcagcggagcggcacggtcgtgttcaacagcgtggggggctcggtggcggccctggccggggtctgcctcgacgcggtggaggctttccgtctccccgtggcgctgaacttgtacatgacagcccccgggcagtccacctcggcgcccccgcacacggacaagcaggacgtgttcgtcctccagacccaaggccggaagcggtggcgggtctacgcgccccctgcccctcttaagaagccctccgtcgaccccttcgcccgcggcaaggaccaggacaggctccgtctgggggagctgggcccccccctggtcgacacggtactggggcccgggcaggtgctgtacatgccggcgggtttcccgcacacgaccgacacggtggtgggcatggccgaggagagggacccctccgtgcacctgaccctgggggtggacacgcacatctgggggctcacgcacgccgccctccgcgactacttcctctaccgcctccagccgggccccactgccacgcttcccccaccgcccccgtccacccagaccctccccgannnnnnnnnnggatgcgaggcggcgcgagggtacagctgtggctccggagtggcggcctcgtggacgatcctttgcagcggaccaccttctccctgcgggtaccggccgcggcgctggggcacgagctggcggggggggtcatg

SEQ ID NO: 7684 - DNA, 700 bp, Nannochloropsis_gaditana
tcgtctcagctccaccccataaggtactccccacttcgcaacgatcatgtcgaaaagctggtagccatccagctctccgatatttttacgctccaccagatcctgcagcactttcttccggtattcctgcatggagggtgagccatctggtgtgattacaaccctcagaggtgctgccgaaaaggatctgcgcactgttgcgactcctgacgaggcagagggagaagagggaataaacgatgccacaggtgcgcacattaataccgccagaagcgacaacagcgaagtagagaacagcgttttcatcctatctgcgtccacgtgtttgactggtcttgctccgtttgctagctctgtcctctataagtatggtcagaatcatggaatgttgggagtgagtaggcaggagtcgaggagacgccttgggctacagacataaccacaagctgacgagaaaagacgccgacgccggcgctcaatagacaaagacacagacggacgggtcagtacgattttcgtgcactccctcgccttgcgcccgacgcaggcacttgctcgcgaggcagggggaggtggtcaggctcgcctcgtcagcacgggcacgagactgcgagttccgaccccgcccccaggcggcctcagggcctgggtcgccttgtctcgatgctcattccttgccatgccatgccatgccatgaaa

SEQ ID NO: 7685 - DNA, 700 bp, Nannochloropsis_gaditana
  misc_feature (1)..(269): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagcatggaggctcttacgcccccccccgaggcctccctgctcgccgtgggaggccggtactggcagctcgaggacctggcgccgccagcgacagacatggagacggtcacgccttccgagctgaatgacctatccctatcaatgcagtcgattagcgggcggatgtcggtttggtagcgccttgctcgaggtagaggcgagggaagttaactttacccccacccctcgctggctcgcaggaaagaaaaagaccactgaaacagagccccccccctggcagaaccttgctttctgcaagcaaatgttcttttccgcccgtagtttctgagcgaatcacccgagcacagcccgtgcatccctcaacccggcgcggggtcggcgccctccctgcgtcggccccaccagaaggagacagagaaggacgggctc

SEQ ID NO: 7686 - DNA, 700 bp, Nannochloropsis_gaditana
tgacgtctcactgcacgcaagccaagtcctgctggagccccccttcggggatgggccctaccgtcggcgaggacggcgacgcccttgccctctaggaaaagtaaggtcctgggttgcctgccagccttcaaacaagagagaagaataaggtgtgaatgagtacgtaaggtaactgcgggcacataaaaaaagtcgggggtcgggacgggctcgcgcgtttctaggagcgggtcgcctcttagctatcgcccacggtcgcttgccttccgccctccttcaacattctgtgccctgacaggtcaatcctaacataggatgcaaatctggtccatttattaatacaggagccgcgtagatatcaaattttaccacgtcgagctgtcgtagctgcgaagctattcttcgtacgaccccctgaacatcatagctttctcctttcatcattcttctttaccttggagtgcgcatacttttctaatatatttccatgtggaactgtgggaggctggtaaaaatacacatttcattaccatggaggacatcaggatcagtgttgtattcccggagtttgatgtcacacggcagcacgtctgcaacgcctgttgaggggtcccctccatcttcgaagcccttcaccaagctccttatagccaatcgcggcgagattgcatgccgcatcattcgcacggcccgaaaaatg

SEQ ID NO: 7687 - DNA, 700 bp, Nannochloropsis_gaditana; identical to SEQ ID NO: 4641

SEQ ID NO: 7688 - DNA, 700 bp, Nannochloropsis_gaditana
agaggagcagttagccaagcttcgtcattctctcacttcgcaaatcgattcattggtgcagcaactcaatgatgagaagatgtttggcttcacggaaaacaatgacacccagaattctgcaagcggcttttccacatccggagcggtgggcaaagcgttggctgctaaagatcagtcgcttacgtcgcagattgaatcaaaagtacgcaaaattgaccaggagcttcagcgctggaaagaatggcgggtgaagatgacaacaagcgggaaggagcacagtgaaaggaatcagtccctcttcaatgagaagcgagccctttcagatcagtaccgcaagcttaagtcacatatgaataagtttcgccagaagcagtatgatgcgcttcaagtgctaaacaaagtggcggcttcttcccttgaacgcctggacggtcaagtggaggtacgtgcaagggaggtgtcatttctagcacggaccatactatgctaaaagcatcaccatatgagacttactctatatataccgtcgcggtccagcttggcctacgagtgttgcatctagcagagtgggctcacaagaaggaggtggagcaaagcagagccagaggcctccctaaagccgcggagggcgcggcgaccagcctgcccagctcccctcatggtggcgatggcgaaggacccgaaaagaacgaagagaatg

SEQ ID NO: 7689 - DNA, 700 bp, Nannochloropsis_gaditana
acgacatgaatacttacctcgggggggtagccctcccgacccggaggcggttgtccaccccgattcccctggatggaccagggaataggacgaaaatatggaaataagcacatttgaagcaataatccctggctagatgtgagatgttcttacttgctgttgatgaaaaggcggagcaggtgcactgctacgtgacggaggaggggggggaggcgggggatggtattgaccatgttgttgctgctgcggctgccatccattttccgcccgcaccatgctcaagactcctccggcaagcattgtgatggcggcaaaaggatgttttttgggcagataccttctttctctccttgaaggagctgcgacccctccggatgcgaccatcctgcttgtcgctcgtaacgttcagagaggtcgtccctgcatgaaagggtaccagaggccgtgaaaagtacgttttgttggcatgtatcaagccggcataataatgtgaagcctgcatcagtatttgaggggctggctgacaaattaagggtttgccttccccctagtacctcgatgatcgcctccgtcgcccctccgtcccagcgaggccgtcgtgaaccccctcactgcctccgttccggctcaaaaggacgcattgcatccactgatctcccacaactctctcgagacaggctgtggacaacccattattatg

SEQ ID NO: 7690 - DNA, 367 bp, Nannochloropsis_gaditana
gacctgcctgcagctgagcgtccagcaaatcaaggacggggcagaggagggcgggagggagggggacgaaggcgaggggattgccggtgggagcgacaagccccggagtcggtacccggtaatcattggcgtggcggcggtcttgcacgcagctctgcagaaccgctttgtcctgtcttgcctggagggggcgcaagtagcgactttggaggaggctcaggcgcgctggtgcctgttcaacgaggagttttacccctccgaggccgacaagctcgcgcactaccgggatcagtggggtttggctttcaggcccgtccctcctccctccatcctgcccaaggtggcgaacgcccttacggaggaaatg

SEQ ID NO: 7691 - DNA, 700 bp, Nannochloropsis_gaditana
ggccatcctaactaacgccaggacgactgtgacgggcacatttcaattgatatgccccgatccgagtttgttggcgttaatttgtcgtaaggctgcccggtaatggtggtacgagtgaacgcgtcctccactcaagccgacctggccgtcacgatacgatgcttgcggttttcaggccttcaatttcaacaagtgcaacccttttctggtgtcgaaaatccacacaataggttacaggacattattcctaggccgtggaaggggtataagaggagattgtgggcctgcttccctgatctttgggtcctaaataccttcctggtgctcctcccttgccctgccccttggtgcattggttttccagtcccctacctcacaaaggtaagaccaagcactctcaaaaaatcatttctgcctttcttttaaaaattgcaacccgtgtacttataccaggaggtccgtggtgcgagtgtcgggttttttgttcttttctttcttggaactctttcaagtccgtgagtccttttaatcctcctgccaggattagggatagggctagtacccctcaaaaccccgctttcgccgtgacctaccatcctcatacgtcctccgcactcattacaactatgagcttcgttttgtatcccacaattgattcctcttcgtttatctccaacatagccgacatcactccaggatg

SEQ ID NO: 7692 - DNA, 700 bp, Nannochloropsis_gaditana; identical to SEQ ID NO: 5307

SEQ ID NO: 7693 - DNA, 700 bp, Nannochloropsis_gaditana
tgcactacagcttcggcgacaaaggtggggaggcggtggaggccgagcaggtggaactcccccacctgaccttcccgctctcccgaggcatggaccggctggtcgtgaccccggcggggcaggaaccccctccgctggggaaggagttcaacgagccggacgagacgcgagtcccgcggcgaggggggaaagggaaagagcccgagtttgtgctggggccaatctactccatgtctttccactccatgtacctggatttctcccagtggcagctggtcaacatcgcggggcagaagtccatcgacctgggcgggtacttcggggacgcctcggtccacattgtcgtctacgacctgcacaattccgtggcggccagtccggggggcgcgcatcggcggtgcgacaagcggtatttctatcactgcgagctggtggcggctggcggcgaagcggggctgggagaggaagacacagacaggctgagcgcgaccgaggctgggatgagcagcagcggcctccatggatctgtcttccctggtcactcgccgggtgctcgcccgagccgcgtgcgctccagaagcagcgacgggggcggggaaggaggacgaaaggagaaagtgggcagtgttgtgggcgcagggggggatggtgtggagatggacgggctggcaagtaccttggacgcgggtcgtgacgggtt

SEQ ID NO: 7694 - DNA, 700 bp, Nannochloropsis_gaditana
tttggagcccaggacattgctgcctgcaaggcatagggcgcaccaggcgcatgtaaatactgtccgccgcgcccgttcctccagcgagtgatggtgacaatccacgtcctccttatcgcggccatcaaataggacctcggcttgtgtcgacgagggaagcggcgccgcggaaggtcccagggagtaggaggtaggagcgccgccatcggcagcccaccgccctcgcaggtctcggtgcctcatggtcgtcgggagaaaaccaaggacatgaacccaggcattcctgtgtaagttggtcgtgaagaatgtttcaggcaagagtgatgatgcatccaaggcgtcccggtgcattccgctttgtagtaaatgcgagtctctcccagcataattctgcgtttcacacccctccgtccggtcacgtcaaatacaacatctcgccgatctccttgcggccgtgccaccgccaattacctcgttcaacaaggcctttccttgcatgcaaaatgccgaaatgttgattatgtggataaggttgtacgggggcatttttcctgctagactatgttccttaatccacaagccaagcttctgttgaagacaaaatgccttaataatcttatgcccatgcgatgataaggtttcgagcaagcggaacacgtttgtcgctcacatccagttgcacacttcccttccattcagg

SEQ ID NO: 7695 - DNA, 700 bp, Nannochloropsis_gaditana
  misc_feature (1)..(326): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcccgggccctgtgggagtcgcactggagggaggaatggatggtcttgtaccccagccacgtctctttcttcgccatgggcacgaaaaagccgggctggtcggtcttcctccacgacatcctcgggctcaaggtcccctcgagcagcagcaagctatctgcgcactttcccggcagcttcttcttgtcccttgagactctggggagggtgcactacctctggttcgcctcggagaccacccgggacagctggctgacggccctgaccgcgcgggtggggggccaagccgggtatgaaatgcccgtgggagtcattatttccgatccacgtgaggctttcgtcctcaagtcaggccaatggcaacctcgcag

SEQ ID NO: 7696 - DNA, 700 bp, Nannochloropsis_gaditana; identical to SEQ ID NO: 5571

SEQ ID NO: 7697 - DNA, 700 bp, Nannochloropsis_gaditana
atcagctccttcactcttggcctggcgagctgcggcacgtgctattgcggcgaatccatttacttgagcctgaatttgagagcgctcaccttccgctcgtcgctccacctcgacaatttccttctgcaattttataagttcgtttgattgagtatctaagcgctcgcgtatttgttgtggggtgattcctcccagtatgcgacgagggtcctccggctcgaaaaagtcgctatcaggtccaaagttacgattccatgaatcaataatttgtgaatcggaatgatgtgagttttttttcacacaaaattgacaggaagagggtagtgatgcgaaagacgatatatatgccgcgtcgatgtctccatgcaggcctttactacgcggtcccctcgtatacatggcctgcattgtgggttaggctagttggtaagcacgaggaaagatacaacgacagccatgcttaagccaggcaggtttgtccacgatcaggttgcttcacactaagactgggatggtagatcacccgaacgctggatgtggtgacatctcaaggcccgcgcggcccaccttaaagcaacgggacggcttcgtggaacggctcccggaccgttgaatcggcgataacgaccggcaacttgtgctgcccgtgaaatccttccacaagacactgatttacaataccatctaggttggtgcgatg

SEQ ID NO: 7698 - DNA, 700 bp, Nannochloropsis_gaditana
aaaagcggaatgaccgtgccgaacgtggggtatgatgtgctggacaccagcggcacggctccccacaagaattctaggaattcaacgccgtaaaagaaggcgtcaaatgagaatgcacacaagcggaaaccttcatacagccgtacaggcaccgtgtcttgctcacacacagaggactgcctcgcactcgtgccgtcatgccgagaaaggatcgcgtcccctccctgtctgtagctagccaccaccagtctcacctgcacctcgtcctcgcagccaacgatgtctcactgcatgacccaattaagggacgaaacgaggttcaacgcctgcttaagaggagagctaggagggcgaggggagggtgatgcatggagccaaaggcaggcggtgaccggcgtcgcaatggaggcatgggtctcgaggacataagtgccaggactcgcccgccggcctcgctggatgcgcgcatggcaagatggcgaccccccttgtgtgcctggacgttttttgcgctcgtcatcccctcacatccgcacacaaaaaacacaggaagtaaaggacaacacactgtatatacgatagtaatttgtcgcgtcttcgtggcagctcacacgcccctgaactgcgccgcactccggcgtcgaaacggcccacacgacattccctcgaaaacccagccattcctactgacacaaacatg

SEQ ID NO: 7699 - DNA, 700 bp, Nannochloropsis_gaditana
ggcactgtcaactctgcggccttccgtgagtgaaaaggacttggacacccttctggcttggaatgacgactttggcaccttttcacgacaaaaatgtaacgtcggggatggttagggcgcagaagagccgaggaatgatcgatcaaaaaccttttacgaagcaggacagggtagacagagatgcatgtgaccatgttgataaggcggtgtgaggcaacagggcaaaaaaaattactccgcaaaacatttcatcgtagctctcaagaggtctgaatagcaacgctttacacgtatcacgctgtccccatgcactgacaccgcagccccgcgaacctcttccctcccttgaagcgcctagatggatatgggccaatcgccctccgcgtactgacgcaagcgaggccggatccgggggccaggcgtggtcgccgtgtgaacgataattcacttatcttgctggcatggaatgggcggcactggacacccatcccaaattatgagcaatttacatgcatccatatcgcgatgtccacgtttggcttgcggcccctgccacggggggtcccaggtggggtatgttcaccatcatcactgccccgtgacaagaatcgaggagaattacactttccgccaccattctccaacacaacacgaccctggcttccgccataaaatacagatgcaggacaaaactgaaatg

SEQ ID NO: 7700 - DNA, 700 bp, Nannochloropsis_gaditana
accaaatttagcgacagcatggtaccttcctccctctcctcctccttgccatctttggagccacgcgtcacagcgctgaggacacctgcaggtctgacacacgagacagctcactcaagtccatgcgcattagtcagtggtatatcttgtctttgccttctggaggtagctttggcaaagcaagccctcgccgctggtcctttgacaaataaaataacatgtcaacaacgggcacttcgtgttctggtgcagcaagaacgcttgaagattgtccaacaacaagtacaagagtatccgcttcctgaggcttcatcaacggctgagagagtaacagttacgtccgaattgctgagtgacgcctcttttttgacagacgaggaggatgtgctggcactaatgacaaggtgggatggtccgactcccagccatgaatcgcctctccaaaatgtagtgatggaacaagggcggacatcggtaatcaaggagtacagaacaaaggagcgacaagacgcagcggcgctgaagaaccttcttcagcatcaccatctatcggacagtacgctcacaggggtccagcgtcaaggtccatttgcgcccccaacctcttcgaggcaacctcatgtgatctccaatgtctcaatacagcattttcgttcacctgtttcttatggcggggcggtaacgtcatctcaccatgatg

SEQ ID NO: 7701 - DNA, 700 bp, Nannochloropsis_gaditana
atggcaagcccatgcatcgcccttgcccttgtcgcagtccatttcgaatgccagcatccgctcctcatactcgggatcgatagcttgaagcccctcgatcatgaccgtcttacttgcctcaatctatccaggcctaagcagagtgttcgttgtgagccagtactattattcacgtatgatgccgtgtcattcatgtcattcattcagtcgtactggcgactctcacgtatggatgcatgagattcgcaacttgctagtgtatacgtaccgttccacacttctctttggtcccttcttggagatccttaaaggtacagagggatgcacgtcgcgagtggggaggttggtgagtagctagtgtatacgtaccgttccacacttctctttggtcccgtcttggagatccttacaggtacagaggaatgcacgtcgcgagtggggaggttggtgagtagccattcgtcgcacatggagacgaagcactgtcatcaggatggctgtgtgaccttctaaggaaggatgtaaggaagcaggcacgtacatccctgagtcacatggatgggcaagtgcctcgcccaattttgacgttctctcttccttgtccccttgcagaggacaaccgcttccgcctggttcgttcctttttcttgcaggtcgcacaactcctcttcaatttgatatcagttcactctcgattcag

SEQ ID NO: 7702 - DNA, 700 bp, Nannochloropsis_gaditana
cttcatagccagcgtcttcctctgccacagcatgcggatccaaaagcacgttgctcagttgtgtgtatcccggcccccatgaccacacgcgcacgaacccctcgggcatcgagcccgtgaagaggcggtcgcccagattgctgtagttgatgtcggtgaccgccgacttgtgcgcctgcaaccggcagaccagcgtgctcgtgccttcctcttgtgacgcgggaggtccgagtcgatcgtgtggcggctgcaacgcgctcgggaggccgtttgtcgtcgctgcggtccgtcggccccctggtctcgagctccctgcccacccgcttgtcgacgacgcggagctcaagagccgcgcctcctcttccgcccgtccccccttcctttccgggccttccaacgaccaaatgcggcccacgccgtcctctgcccccgtggccaagaaaccgcccaggggacacacggagaggcacttgacacgcgcccgttcctccgtgcccccgcctgcggaggtgtggtcgaggacaaccggggaaggaagggcgtcggaggcgacaggaggcagcggggaggccttctcctggaaggtgtactttagtgcgcccaggtcccacacgcgggcggagccgtcatccgagcccgtgagcaacaggttgtagaaagggtggaagtgcacgtagttgatggtatcagtgtggccacg

SEQ ID NO: 7703 - DNA, 700 bp, Nannochloropsis_gaditana; identical to SEQ ID NO: 4567

SEQ ID NO: 7704 - DNA, 700 bp, Nannochloropsis_gaditana
ctctctaccattttatttcgagcatgttttccatccaagtgagtcttccatataaagggggctgcgtggtgagaaagcgtgggacgtggccgcttacctcgagaaacaatgggagcttggaaggcattgcataccgcagccaggagcaaaagagatgcaatcacgcgcatgttgaataactgtgacatgttttgtgagacgtgaataacatttgtgatgatggaatccggaacaaactagtcgtcgaagtggcagcccatcataaagatcgagggagcgctctgaccacttaacgcacgatcatgcaacccatcacattccatttttcaatctgcctcacgcgcagcagcattgtcttccaaccatggccatagaacttgctgaaagcatccaaggccgttccacacaggcgcccaagaagggtggcgtgtcaggctgacgcagcgtcattcttttaacctcctggctctgccaagctcggtatacgcccccgccccttgatagagcctcgccctctcgccgggcacaaccggcgctcctcaacccggggtggatatgaagtttggcggatcataagctcatcacgttgcgtctctcttctcctcgatggcaggagctggaagagcgggtaacttgggctgccggcgtggagaatcaagagcgggtatccggctgtctcgtttttcttcctgttgccatg

SEQ ID NO: 7705 - DNA, 700 bp, Nannochloropsis_gaditana
ggaagggataaaggcggaaaaaggggggatgaaatgtcaaagtacctttcgtcatgcgtgttgtgacgctgttggtgaagcgaatatttttgcgctttgttacggctacgttcatcctttttcaccgcgaggatgctatccttttatttaacaacaccgatgtcttttattcttctaatcggacttttcgatagaccagaccattgggcagaaagagatcttgacggaacactacgactgatgacgatgtagttgacacaaagacaacagatgaaagcgacctgctttgtcgtaaaatgccactcgttcgcctgagctttatgtgataaccattacgagagatatggtaccatacaagagacgtttggaccaaggtttcaacatgctccatgcaggccacgctattcacatcttacacttggcgtggaacacgactcggagtttcggagttccgtcggctacacataaagcgcatcttgttccctccaaaagccatccaagacctgacgacggcatccttgcgttctgaaaagctgaggtggacttaataaccgctttcatcttgttttctattaatttgtggaattttaaagctggctttctaattcactttcgggtctcatttttgtcaaatcagtctccaggacgggcgacgtgattcaattcttcaaagaaagaaaaagtttcgttgacaattatg

SEQ ID NO: 7706 - DNA, 700 bp, Nannochloropsis_gaditana; identical to SEQ ID NO: 4799

SEQ ID NO: 7707 - DNA, 700 bp, Nannochloropsis_gaditana; identical to SEQ ID NO: 4798

SEQ ID NO: 7708 - DNA, 700 bp, Nannochloropsis_gaditana; identical to SEQ ID NO: 5246

SEQ ID NO: 7709 - DNA, 700 bp, Nannochloropsis_gaditana
cgtgtatctggaacaaaatatgcgccgtttgaaacacataagttatcttattcatctgaagggttttatgtgatatcatggcgggagagttcgaaaaagtgaactcatacaggaagtgacgcatagctgtacaacattgaaaagtagacgtgattcgaccactctgaggacagaatcttattatgcatcgatccaattggaaaaaaacatctgcacggcttttcttcaggctggtagcgcttcatggaccattcgacattgacattaacacacgcgaataacttgccgtatgaatgtctgacgcatggcgcgctccaaggacagacccgactccggaaatcgctgggaaaccgccccgaggcgtgtattatttatgcggtgacggtccaagcgccgccgccgtccggttaagctgtcgccagggcccttcactcatcctgcagggagcacggcggtcacacgtgccgcgtacacgcccggtggaaggtcgggttttgtgtctgttcgtgcccggggcccttggcctatttggtcgacggcaacgacgttttgcgttgttgcgtgcatctcagggctggaggcgcgatgaaatcccaatcgacacaagaagagccctcgccaggctgagagaaagccgaacattcatccgcggacaaaacggatgccttttcacgcgttctaccaaccattctccgcacaa

SEQ ID NO: 7710 - DNA, 700 bp, Nannochloropsis_gaditana
gcttctgctcgactttcaatggtggcgagacggggcgtcgtcgagaagatcgggcagtcgtgttggcagtgctcgtacaaacccagacgcgatccaatacaaacttgaacagaggtcctccttacagtttgaaatgcatatgtataagtcttgagtgatgatatgcatacaaagaaaatagatgatgattgatgatacggtggcatctgcacgttgcctccgcaagtcgacatgctaggcttgactaacgggagccgagggctagcagctctggtgctgtattactcttgccgcgtacagcactaagatacaaagtgacttgtaatatagcgaaatatatcatagaaatcgagtgtaaaggacaaatggtttacctgaggcagagtgcacgacggggaagagacgttttatcgaacaaacgtgtcgtttcgcgggaaaccgttactcccccgggcaacggttcattcaaacgggcgtttcaaattctccccggcatgatgagtgattcagcgcccgtgatcgaccccaccactacatttgatcataccatttgtgctccactcgtcgccttacccgtttctcttcccttcacgtacaacatggaaacatgatggctttcttgaaacatctcgaggcgggctcaaatccaaattctaaattccacagacagcgatcaaacacacctgctacaagtgagatg

SEQ ID NO: 7711 - DNA, 700 bp, Nannochloropsis_gaditana
accctcctcgtcttttgcctctacctcatctgcctacacttggattgctgcctacaaaattgaggagctctcccgcttctcaaatcttcaatctttgcatttgaattggcaatcagccttcaactacaacagcgataagactattgcacattccatgacatctcctgccgaacacacagcgtcttcctttacgcttcaggcttcaacaagctcgaatctgagcgcattggacggactcggctggtctcgtcctcctcccgcaacggcttctttagccaaattatggacggtctggcatcgtcctggaacatgttcagacaaacctctcttggcaggtgtggcgggtcttccagaatgtgatgaggctggtccatttttgctggctgacaaatctttacgacaggaggaagaagtttgcaacctcattctgcgagctctagaaaaaaatcctgttcgccacagcagctctgctacccaatacgaagcagacggagaagagaaagtagaacgtgtctcctgggtcaacaatcacggccatgatctcctccccaaatccagcaaaggcttgccccggccccttatgcatcgactgaacgtgttgcacaagggggcgggcatacttgtgcgggacgcgcaaagcagggtgttcgtgcatcaacgatccgcacacaagcggattttcccctctttgtacgacatg

SEQ ID NO: 7712 - DNA, 700 bp, Nannochloropsis_gaditana
ctccaccttcttgggtgcttgcggcaggtcttcatcaagacactcgtcgaggacaggaaccgattcggctgattctgccgtcgttgcaaaggtctggacgtgttgaaatgccaatgcacaaaagagaatcacatagactattctgcgcaaccgcatgttcatggtaatttatccttttggatgacgatgatgatgatgatgatgacgaaaaaatagcaaagacggcccactggaacacggaaaggctcgcgaggaatgaagaacttacacaacccgctccgccacccgcgcctgtggtggcaaaaaagaggcgtgaagagttaaaacactgcgcccggagccatggtgcaggcatgcaagggtgtatcggtgcaaaaagcagaacataggaccggatggtcccagcaacccaggctctcgccgttgccgttacatttccttcttccttgaaggcggactcggaccacgcggccggggatggcctatgctggtggaggagggccatttggacgcagactttcgctctgacattgtcgtatgagaggcaggatggtttgcaagggtcccaatcggcaaagaattcctatacgggaattgttttctcctagactttgcgaaccgattcgatctgccgaaaccttttgaaccttattccttttcttccatgctcgagacagacatcgttaccaccaggatcatg

SEQ ID NO: 7713 - DNA, 700 bp, Nannochloropsis_gaditana
gagagggtgtgcgaataagaggaactcagacaggaaaccataggatgctcttgccagttagacaggaaaacggtgcctgcggtgtctatctacacatatccgcttcatgttgcttttctttgcgcatctctgccatggctttagaacccttccccagagttttcactcaaagctccaggactttgaggagaagagggagcaggggaggtcaccgtggcccccgcattccgtgtggaagtcgtgttttctaccttctacttgcctgtcgcagtgtgcccacaccccttgcgtaaagcatggatcttttcttcttcacttgtgcgactggggccgcgggatgcgggtagaccatacaaagcgtcggcccccaggctcgatcgctgcctcgcccgccaaagttcaaccctcctcccccctatgctctctacagggaaccatggccgccagagcaccgcgtcctctgcgcgaccgagatctacgacccgtcctttcccctccaagacacgcctcgctggacgagcctgtgaggcttcctgtgcttctttacgtcccaaatctgctctgttatgcccgcctcctcctcagcatctacggcctctccatggtaatccagacagtcttgcgtcaacaggaagcttctcgccgcgctctcttggccggagaagcagcaaattgctcagtgcaggctgtcgtgcagatg

SEQ ID NO: 7714 - DNA, 700 bp, Nannochloropsis_gaditana
cgagtgggccagtgctaaatggcaaaaacatgctggcacctcccgcgcacaccgtgccaagcccccccctgctgtagagcataagaagtgtcggaacgagctcatggagtgtgcgcgcctccggcctggcagcggggcgggataaattgctttaatctgggtcgattgccactactttgacccctcgctctctgtctctcgctcccagccccgtcactcctgcctcgtaggggctcaattccaccgcatttctgtcaactcaggagggaaggacatctgtacagcgctgtctttgttggcttctcacatttttccagttgtccaggtgccagcttttactttgtctctgctacacccttcattttgtcctttgttccatttcagttccatcctgaaacaactttcacagcttgctcggccccccgcgtcctcacaggcaagaagcgcctcccaaaatagtggcaggccactgtagccactcgttactgctgtattagcatcatcatttggagctgtggacactacaacccagcgccgatattgcaacgatagcagggggccacagccgttcctctcttcctcccccgccttcctgtacggtcgggactctgggagtttctggaggcccttgactttgaaagggtcaccgatagcatcatttcaatccaatcttgacgcagaggcccgagcagcaagcatg

SEQ ID NO: 7715 - DNA, 700 bp, Nannochloropsis_gaditana
tcgcttcctctactcgaagggtggatttcaaaagggagaaagagaatgggaatggcgaatcgttgattcggaagcctcgtcggccgctaactcccgcgcccgtgcagcgagagattcgtgccatcgacacagctcatttcccgcgcatgcgcgcatgaaacgtctaagccacagtcgaggctcttaagcactctcctgcgtccccggcacgtgctctccgtgccgggaagatgctaagcccctcgcttacccatacacccttccagtcggtcccaaacatgggtgtcggtaatggagagccgccgtgccatgcttcgcgggcaggatggtgtcgagggatgccaccagagccctgtgtgtccttcagtgtgagggactggagagggttagggagcgggctcgccattagtaagcaaagcatggcttgtggagcgcagacacaagccccgaggcttcaagtccggcgagtgggccagtgctaaatggcaaaaacatgctggcacctcccgcgcacaccgtgccaagcccccccctgctgtagagcataagaagtgtcggaacgagctcatggagtgtgcgcgcctccggcctggcagcggggcgggataaattgctttaatctgggtcgattgccactactttgacccctcgctctctgtctctcgctcccagccccgtcactcctgcctcgtaggggctc

SEQ ID NO: 7716 - DNA, 700 bp, Nannochloropsis_gaditana; identical to SEQ ID NO: 4440

SEQ ID NO: 7717 - DNA, 700 bp, Nannochloropsis_gaditana; identical to SEQ ID NO: 4441

SEQ ID NO: 7718 - DNA, 700 bp, Nannochloropsis_gaditana
tctacccttaactataaggtgacccgcagtttctagctccgaaaacgtcctgtagcctccttcgccctttttcgtcgtcgaatgtgtgcctgttcaaggttctccgatttgcgtgctattacggttgtctgcgcttgaaggagagtcctgttacagcaacctggccagcgatcctccttgacccactaaatctttcctttgaaggaggaaggcaccctgggttttccctctcattggccggtgcatgcaccttggtctccatgaccagacccacatgttggtatatcgtcaaatagttgatgttggttgggttgatgggtttgcgtgggtggtcatgatgagtggaggattaggagcaatccttcccctcctgttgccttgtggaagggaagcgagcgcgggtgtttacctttactgcaggccttggtgttatacaccctgtcttcgtacactcagatgaataagaaattttgtggcttgtacttacttaacagactgtggcattttgtgaagttgtggattgtcttgaagagggctggtatcatgcactctccacccttctgagagcttctgcattcaagacacatctctgtttacgtcgcaaatatgtgtcaattctcacatgacaattttcatacaacatttttaccattgttacagtcgcctttccattcctagtcatcttctcactaaaaccatg

SEQ ID NO: 7719 - DNA, 700 bp, Nannochloropsis_gaditana
acatagcctcattaggagatagaaatgggtgatgtggtggaggaagggaaccttggtgacacgatttggccttggcacgtccaatattcatgaaagctctggcttctgacagtcattttgccacgtcctctgatcgttttccattcgtacaggtcgcaccgtcccgtgcctttcattcattttttgaggctttctgaagagaaaacgggagcaaagagagaacgagaagagaatacctgtgcgtcaagatcattgcctgtacttgcgcaaggtctcgagcgcaaaagattcctcttgtcatggcaacgcgacaagtagaataccataccgtccaagtggccagggagtcatttttcctagatgtccggtgagataagggggaaacagagaggatagggcaggggccaatggatttaaacacggcagtaccggaacaaaagatcatcgaataaaatacataggttccctaactttatgatgagaaggaatgagtcacatcttgctcatcgactgcaatctccttgccataggtacactaatcttaaacctattggagatggttcttacggatttgtctgcgccgccgatgactcggtaagtatgtgcctaagatctaagcactgacttaggccccgcttctcaagatcgatgccaaagatgtcaatgtaaatgaaaatctgacccttggctctcaaaaatg

SEQ ID NO: 7720 - DNA, 700 bp, Nannochloropsis_gaditana
tcaggccgtttctggcctcggtcctgtcactctcctgccctgtcaggcgttcgaatgcatgttgcacgtggtctccgggtgataactttcgttatcccccgatataggtctcgcgcttggggcggtaaaacaccttttggttgtgcagccgacccaacaggtcatgaatacggcgggccggatcctgagaggcggcttcgccaatcggtgcgtcatcatttgacgcggttttcacaagatccctggaataatcgtttttcgcacgcaggagtgcatcctcgatcagtgccatatcttcgacagacagttcaaaattgacgttgtagcgcgccatgatgtgcctccgttcctgcgggatcgccgccataagtttacctgatggtatgttctgccagccttaatacaggagcggatgcccttacgacaagcgtaaaaatcagcgatgcgtcaatgtgttaccgaccgcacgggatacgagggaatacaggctcgccgcatgcgtttgcacaccgacaccggccaatgcaccccgatttggtgtaagtcgttggcctgccacacgctctttgccgcgccgccgcgcaggccaggcgcaacgcatggcttgacttgccccggacagacggcgaaaacgcagtcgcacaaataacccgcaaccgggcgttccgtgggcgccaaactgacgaggaggccgaacatg

SEQ ID NO: 7721 - DNA, 700 bp, Nannochloropsis_gaditana
gcggtgcgcactttcgtgcgaatcgaaaagctggatcgcggccccggcgcgcttggggtggagattgtccgctccgtcgatgaccttaagaccaagccggtggcgcaccatcccgacatcacgccgcatccgcatgtggtctacctgacgaattcggcgatccgctctcccaatctggcgcgttggctggaccagcttgaggcccgcaaggaaccggcgatcctgtgcgtcggtcatgccgacgaggccagccccaaaaccggccaccgcatgacccagcgtcgcgtcgacctgctggcgctggagcagaacgcgtgggttctgggcgggcgcgacgaccgttgcgtcgtggtcggcagccgcacagaactggattgggcgatgaaaaacggccagatcagcgtttgggcaccgtccaagatcgtgctggacgcggttgacggccccaagaccggcccggacgacccgattgcactggccgcatggtttgccggtcatatggatgcgtcggacctgcttttgatcggcgtggccccgcccgccaatccgcccgtgccggtgctgattcaggatatcgcgcaatccgggctttgatgcctgcggtgtcacccatgttttcaagcctttgagccaaggtgccctgatgcgctattaccgcccgattccccaaacggatgccgcccggcccgctggcgccatg

SEQ ID NO: 7722 - DNA, 700 bp, Nannochloropsis_gaditana
tggtgcgcaagaaggccgacagggtcatggaccgctcggatgaaagctgaggccacgtaaacccggcaggcattgaccgggacaggctcaagatcacgcaacgccgcttttcttgtgtccgcgcatcgcctataagcggtcagatacggcgcgacccatgaatgacgcgccgctgtaaccggttcgaggaaatggatgcccaacaagaccaatgatgccgacgtcgccttcatcaaggcgctggcagagcttttgaacgataatgatctgaccgagctggaagtaaagcgcgactacggcgaaaacgatacgctgaatgtccgtgtcagccgcaagaccaaggtgatcgcacaggccgcacttcccgcgcccgtccccgcgccaaccggcggcaccccggccctgtcagcgccccccgccccagaggcgcccagcgaagaccccgccagccaccccggcgcggtcacgtcgcccatggtcggcaccgtttacatgcaggcagagcccggcgcaccctctttcgtcagcgtgggcgaccgcgtctccgagggcgacacgctgttgatcgtcgaggcgatgaaaaccatgaaccatatccccgcgccacgcgccggcaccgtcaaacgcatccttgtcgaggatggcgcggcggtggaatatggtgccccactcatgatcatcgaataagggcgggcgcatg

SEQ ID NO: 7723 - DNA, 700 bp, Nannochloropsis_gaditana
gggggggcgacctgcccgctgacccactgataaagatcctgatcgttttcttcgagcaacgcgtcataaagatccagctcggcctcggacaggctgtcaagccgggccttggagaaccggatcaggatgacatccatttccttgatgccgcgccgcattgaccgcatggtcagccgacgcaggcgcacatcacgtggttcggtggtcgcgtcactcaacgtcacgcacctccagatggctgcgcagggatttttccagccgtccaagccgttcggaggcattgacgatatgcgcacgcaggtcgcgcagctctgtcagcatgttcgtcgcatccggggccatggtcagatccgagggcgcatcggggccatcgccctgccctgtcaaaagccagggcagcggcacgttgagcatccccgccagcatcgacagcttgttggcgcgcggctcgctcaggtcgttttcccagcccttaagggtcttgagtttgacaccaagcctgcgggccaggtctttttgcgacatgccggacgcatcacgcgctccggcaagacgatcaccgaatgtggttgcctcgggatcgaaccaatcgtcggagctgggggcgttcatgctgtccttcccggccgcggggccattcttattcatgttgtacctgccttggctctaccatagatatctgcgggatccaaaccacatg

SEQ ID NO: 7724 - DNA, 700 bp, Nannochloropsis_gaditana
gccgcgcctttcttgggctgtcgccacttgtctcggggctgatcaccgccgctgtcatccccggcgcggcgctgaccgccagccttgccgcgccgctgccggtttttggtacctccggcccctatctggtcttgcctgtcctgatcgccttttatgcggtgctgctgcgccgtaccgcaccgcgcaccgcccgcaaccttggccttggcgcggggctgttgatcctgtcgctcacctttcgcgggcttgatgcgccgctttgtgatcggctggccatcggcacccatttcctgtggcacctgcttaacgccgtaatgctgggctggatgatcgaaacctaccgccgccacatgcttgcgccctttcccccacggcgctaaacgaggcccaagagagcaggagatgcccccatgtcgatcgacatcgaaaccgccgccaaggtggccaagcttgcccggatccgcgtcgaggcggacgagcttccggcgctggcgcaggaattcaacaccatccttggctttatcgaacagctgtccgaagtggatgtggacggggtcgagccgatgacatccgtgacgcccatgcgccttgcccggcgcgaggacgtggtgaccgatggcgaccagcaggacaagattctgtcgaacgcgccagatgcccgcgaggggttctttgccgtgccgaaggtggtggaataatg

SEQ ID NO: 7725 - DNA, 700 bp, Nannochloropsis_gaditana
gcctccatcgcgcggcggatctcgcggttcttgccctcgcggatcgcgatcgtgacccaggcgttcgccccctgttgacgatccagcgagacctgcatgggctgaaagcgttcgccatccagatcaagccccttgcgcagcggctcgaacgtggcatcttgggggcggccattgacacgcacgcggtacttgcgcacccagcccgtctcgggcagttccagcttgcgcttgacgccgccatcattggtcaaaagcaacagaccctcggaattcaggtcaagccgccccacgctcatcacacgcggcagatcctcgggcagctcgtcgaaaatcgtggtgcggccctgttcgtccttggtggtggtcacaaggccggtgggcttgtgatacagccacaggcgcgccggctcgggcgcgccaagcagacggccatccacttcgacccggtccttgtcggtgacgttgagcgccgcgcggtcgatccgctggccgtttaccttgacacgaccggcggtgatcagccgctctgcctctcggcggctggcaatcccggcgcgggcgatgaccttggcgatgcggtcgccttgcggcgtatcctgagacgagtcctttttcatagcccgcgccatagcccatccccggtccttgcgaaagcgcgcattgcagggcacgtaggggcatgaccttcaaaagccatatg

SEQ ID NO: 7726 - DNA, 700 bp, Nannochloropsis_gaditana
gcttggaaccaagcgcagcacgaccaagacaaaatctaggacgcaaaccgacgggagccctgtaggggatacgggcacccgggggcttgacctcggggagggcctttttcctcccgagcacaaacagtccgcagcgaagaagtccactgtacgcttcaagtatgtcgcaggatacacgaacgcggtgcgccgccctgtctatatgaaagacatgatctaggtgaagggcgggcataagcttgaaacgtgaggagctagtagtgggaaggaagaagttcagggcaagagagacgtgggaacgtaaagtaggataatcgaggaccacccgagtcatcaaaagcactaactggagacgcagtcaacatcgcattttcatgctttacacacacatattcccagtggcatggagaccgtctttggcaccttcttttgcttttccaagctcttacgcctttcggactcagaacgtgacataacacccttcctactgagactcggcctttgtgtcgaccacatccggcttcagtgccccgccgtagacacgacttaatggacctttccttcccacgacgggctaacgtcgcaacaggcgtgacacgtgtgaccgatacagttggccgggcgtccgtaccacaggaatgagcagcatgccggaaagtctctagacggacaaagagcaggcaaggccctctgtgccatg

SEQ ID NO: 7727 - DNA, 700 bp, Nannochloropsis_gaditana
  misc_feature (242)..(251): n is a, c, g, or t
atgccagccagggagaggatacggcccgtcaccccagccgaatgaagcgccgcaagctctacaagggcaagaccggcgccagcgaggaaagtgtggcctttggtctggagaacttggtcctggccacgggatccgcgcaggcccaggtgccccgcctgtcaaagaggacgagagaggctcacctgctgccccggccccctcccgggcagcgggccttgcgcgtagtgacgggccggggcggnnnnnnnnnncagctcctggagtacgtgggagagggcctcaaggaccaagagaaggacatgcttcaagtctgccagtccctcttccgcaagccggcctccaaggcgacggccacgcccgccctcttgcccggggaggagggagcagggacggaggagcgggcacagagccgggtccgcgacaccgaccgggtcatggccagcgtcgcttcctacagcgaccacgcccacgtcctcctggccgcccaggagaactactgccagctccgcttcacggacccgaacctgacgaaagttctgcatgcggcggaatggctggctttctccgacctggtgcaagggcggcagatggaggggctccacgtgatggaggacctgcacctggccaccgccgccgccctccacctgctttgccgcgtggagactcgtccgcgcctggccctgccccgcaaagaccacga

SEQ ID NO: 7728 - DNA, 700 bp, Nannochloropsis_gaditana
  misc_feature (1)..(42): n is a, c, g, or t
nnnnnnnnnnnnnnnnnnnnnnnnnnnnnnnnnnnnnnnnnngacatggtaggagagatcaggagcggcggacgcggggaggctttccggctgccagcgctttctcggatccataatgcgtgaaggacaaatgtatgaacgagagaggccagccccaagttgtaaaaaggacgcgaacgaaagggaaaagaaatgacttgtgaaggaatcatcgcacgccatgtcacttgaacatttaagcctgacacccagcacaatgcaccgtgcagacggcccacccccttccataaaaccccttctgcaaacccaccgcatcagagcatatctctggctctaacttccccctgtaggtcatgcattttatccttttcctcccactatgtcctcgtccacaatccatgccctacttcaagcaccggctcgggactcattgcagacgatgatccgcatcggagcatgaacaccgtaaagtggcaaatcacgtccatgcaggtggttttgcattgatgccgccgacacacagcatcatctttccggcacggacgtccttcgtgtgcaaatcttgcgtgcttgctcttcccgttgatgggccgggcgccgaagcagcacgatcgctccttcacgcgtttatcgctagttcgtggttttctgcacacgggacactcacacgaggtctcacagcacagggaacggagccatg

SEQ ID NO: 7729 - DNA, 436 bp, Nannochloropsis_gaditana
ggaaaatcacttggccgcggtggccggcgacgccggggggggggacaaaagccggtatggacgtgggcctgctctaccgaccgcgggacacggtcttcgggatctggggcacccgccccgactctttcatttttcagagcatcctccggtccatcgagggtggctggctggtcactcgggtcctcagcctgcgcattcaggccaagacaaccacgcaggaccacagcgccctccccgtcctggcgctcaaacgcgccgtcctccgactttcccagcagctcgctccaggtatccttgcttccccggggagtggcacggcgccggcggcggcaaccacggcggccgcgggcgcgcgccgggaggtggacagcgtggtggaggagattcgcacccttttccctcgcctccacgcctacgtcaggaagcgtggaggatt

SEQ ID NO: 7730 - DNA, 700 bp, Nannochloropsis_gaditana
gcgcaagggagagggcatctctctcggggcagcctcacgtaggagcaagggtgaaggaggacgagggaggatcattaacggggggttggcaccacgaggctcaccgagagggaaaggactcagagcagagcggaaagtattgtagttgaaaattttgaaacattgatagtggtcgttttgagcccgggtcgttttgagcccgtgtcgtgtttttcttcccgcacggcatatgaggccgaaggggcgttaccgaaacacacaagcaagacatgccaaaactacgcaaaaatttaacaaatggcgacgcctatcatttaaaaaaaatcccacacgaatgtttcatcaccgcattgaaaacaatgtggttggtcgactttgggcggtaaaaacgcttggtgtcctcgactctcccaccgatatctaaagccattgttgttttcgctgtggggttgcaggcgagtggtggtgcgcctccttgtcttcgggacccccccattgccatttcgaatggcaatacgctacgtgcagttgcttcggaaggtgtattgcatgacgacgtattttgtcagttacatgactggacttttttctcatgtgcactgtttgttgtcatctttttcctcaaatcatcgctcgcctcccccctccttctccgctacgcaacttatccgcctacacacgcgaacagccgacactcatg

SEQ ID NO: 7731 - DNA, 700 bp, Nannochloropsis_gaditana
ggaaggcggccgcgcgcaacgtaaaatgggttcctgctgcgaagcgcacatgacgttagcggtctcgaaaatattcgcctatcgcctgcaaaacccagagctgccccccaaatcccacccacgcatccacccgtggacacgacctgccgcatgcggacatcgacagggcgtggcgccgttcttgatgctgtcgtggcgggtgctgggacgcgggtggcatgttgtggacggtgtcgggcgtgtatgcgtgctttcaaagttagtgacgggtgtggggttgggaggccctaaattcttgttcccggcacaatgggccgcttgagttctccaagaaacctgctaggacagcggattgaacctttttttctctcaccacggcgtgtacctctactactacagggtcaggtgtgcatcggatcgagcagtggacctattgggtacctttaagtgccgtttttgagggcttcacactggaccgttgcgtctacctgctctccccgtttggggggagggccatagaacaactctaacgcactgaaatatggcacccaaatttcaatttcttgaccccagacaatgggcaagcaaaaggaaagacgcgattgagaaagccaacaagtacgtgcaatataaggcaaactgaaatggacctccacgagtttttcacccgtttgtcccacgaaataggttgcgggcagac

SEQ ID NO: 7732 - DNA, 700 bp, Nannochloropsis_gaditana
ggatgaggacaatctcgataaggctgtattaaattatgtattttctccctcggacgataatgcagaaatgtcaatatctgcattgatactcccagtcaagagccttacacagtcactgctgagatccaaagaagtgatggcgagctttacttttgactcacgctggccatgagttacgcgggtgaatggctggtggcgatatccccctcctacaccaataacaggggcggtgcatacatggtccggagctttgggcggaaggagacgtatcaaagtcttcctttgctcatgccgacagtccacttgatgtagttatttgcagggatgggaataccgttgccataagcacttaactttgctcttggcattattggtaccaaaatgacggtaagtgcgccaataagcaatcaaacgccatctgcatacaagatcaaaactttgacgtgcctaaaatatgcgagaccttccttttgcctcaaaatttggtgctccttttcggaggaactgtctctctcagcgacaatgccagcatacatgctgtcgataccccctgagatgcacagtttgattacagtgtctcatcggtatgggtcagcaccacaagcaatggagactacgtggagagtcaacaccccattgtcagaagtgactgtatcggatagcctaaatcgggtgaacagccgtttttaaagtcaatatg

SEQ ID NO: 7733 - DNA, 700 bp, Nannochloropsis_gaditana
tatttgggggggaggcggttgatacagactcctgatgcttcttgaaacaaactctatgcataatcacgtctataaaccatagctcgacactgtcacggcctaagcggtatctctgccatgccctttgtcattccgtaagaaacactcatcgtacatgggaaagatcgtcgtctctgtcacgcggagtaatgcttcaggactccctcgcttgaaggcgatggcccaacgcaacacttgcgacggccgcgacattttgacacttatcccatgttcatacaatcatggacgacttttccgaccctttttattcagaaagaaaaactttgattgttcacaggagtgggcgtgtactgataggaaagatatgtcgagagtacttgtgcacagaaaatgatcagggtgggctggttatagcggagtttcgatgagccatacagacgcaataggtgcttcatatcgggtctctagtagccgcacgacccttaattgtgctttttgagaaacctattcgaagctgtaagcaagtcttgttggcagcctattaaaaaagtcatgtgcaaagcgaccgcagagcaatcatcgccctcgcccaaaattcacttttcttctctagacctcctagtaaagcaatgcttccccctcccccttctttcacaactgcccccaaaagtgcacagacacatagaagccaggcgtcatg

SEQ ID NO: 7734 - DNA, 700 bp, Nannochloropsis_gaditana
ttccactctagccacgccctgcccctattattatgcctcgaaggcaaagccactcagaggcagtgatagagcttctcgcatttttcttacggtgctacacgattttacagggactcccagtgcctcatccccctctccatgatgacgtaagaccagttttcccaaaggtttggtttctaggttttttacccccccatcctacgacccccgggacctcgccgtcgcctttttctcgcccgaaagcaacacaacggaggcgacgaaacccaatatatgtaccgaagatcacgcctgacttgagcgttccccttcaaaaagcgcgtgtcaaaatttaaattccatcggtcacggtctcggactcagtcttggagtgtggttggcgttcatcactattttcagaaggtcattcatgagaatctgaaggatacataggaaagacaagtcctcaactacaaataaagcacccaggagtccatcaataccctctgacgcaatgttttgtcctcatagtgctccaactttccctatagcccaccctgtttattatttcgatgcttagtaggtattcgacgcgtggcgtgggtagggtgaaaggtagagcgactgtctccagaaaaatgacacacagggctttgaggtacacaattcatgtcatgcacatacttactagataaatcaacgtgtaggtttcgctctcatg

SEQ ID NO: 7735 - DNA, 700 bp, Nannochloropsis_gaditana
acttgtggaaaattggtagcttgagtggggcatggatgccaaagaacgtcgcggcacaaggcgtaaattctcacccagtgcggttacaggcatggtgactcgtcgtcgaagcaaacgtggagctacattggtcgcgacggaggagcaagcaggagtgcgcaatgttgaaaatgcagcatgggctaacggcaagaactgcttactgcgcagagttgccgttccgccatgagagagcattgcgtctgtcgagaggagtgcttaccgccggggctaaaagtgttgaagacaatcaagcaaatacaacctgagaaatgacgtgtcatcgcaacgtgagagatgcaaattgtgaagaagcaatatatacagaaccgcgacgcgtcgtcactgttgtgcttcttgtcaacgtggaagaactcaagaagaactgaagctagcgatgattcgatgtcgcaagtatctttccattccgtcaccctctgcgccctccttacgccatatttctcagcggtcgatgaccacaagaacgcgagctaaagccaatgttggcaatgatgttacgcctgccaaggagggcgtagcaacgaggcagcggagacaagcatccgactcctccggccctccctcccaaacgtccctcccacccattaagaaagcagtgaaaaggacttctaacgtggaccaatcagacgacgacgacgac

SEQ ID NO: 7736 - DNA, 700 bp, Nannochloropsis_gaditana
caaacaaatatcatcacgcacatatttttttcgtacaggggtggtagtcgaatgttgggacgattgctcattcgcaagcggccgcgtcctaactttgtcattcgtccgccactcgtacaacctcctggctgcctggtattaccctctacaaagcaacactcttccagcacctcccccacacccgccctcaagcatgtctctctcgtacctgctgacaatgacaatgaagaaagcgaggcggatttgcgggaggagcggactgcgcttgggaaagccttgctcgatccagcttggatgcacgggaggcgggcgcttgccgctccccctgttgaaggtctcgacagaataaacgacgtctcacgactgctgtctggcagacaaattcgtcttcatgccagccgtctcaataggagcaagcgtgaaagcggattggccacggaaagaagtaggaggcccttaaaattgaaagacgggggcctacaggaagaggaggatgcggggggcgagtcgggcgaaagcattgacaagggcaccaaaaacaagagtcatgggcccaagtatgttaaggaggaaaagacaatgatggaagggcatgctgcggaggaagaggggcaaatgatcgagggcgaaagtgaaaagccgggatacaccatccgcaagcccgcgtggacggggcgagtggcttccccccccgaggcgt

SEQ ID NO: 7737 - DNA, 700 bp, Nannochloropsis_gaditana
tcgccgagcagccacctcaacttccttatccacaaagccacgcccacgtggaaaattcaaccggagcctcgtcgatcgaaaccctcttcgacacctccaaacgcctctaccctgtcttgacgcggataccccaagtcctcccctttgctcagcgcgtgcaagtctttcacaagttgttggcggcggacaagcgacaggcacaggacgaagctcaactgttcgggcaccggatccggattcgccgcgcccacatttacgaggacgccttcaaagccttgaaccatcttgggcatggtctccggggccgtgtgcaggtcacttttgtctctgatttggggacggaagaggctgggatcgacggcgggggagtctttaaggagttcatggacgccttgaccaaacgcgcctttgaccctcagtatgctctcttccgcgtcacccctgaccatttgctctaccccaatcctctctcgggactggcagtcggaccggatcatttgcaacattttgcctttctgggtaaagtcttggcgaaagccttgtacgaatccatcttggtggagccacagttcgccatatttttcctgcagcggctgggagggaagctgaacgagacggacgacttgttcagccgcgaccccgagctgtaccggcatttgatgtccttgaaaaggctggcacgggaaggagagggggtcgg

SEQ ID NO: 7738 - DNA, 700 bp, Nannochloropsis_gaditana
tggcgctcgacgacgaggagttttacctgcgtcagactcctctttccctttcgcaagtccttgttctggtagatgcattgaaaggcctcctttatcagatgtactgggtcgaccccaaccgcttgctcttggcatcttcctcttccctgctcccgcccttggaggccctgcagctcacgcgggtggcgactgagcttttcaatcaattgtaccagcgacacagccgccggccgtttcctcccgctattgccgcagaagctgagcgaggcgtgggcgatagggatgccatggaggtcgataccagcacgaccgtccggggctaccacaggagcagggccggtctcactgcacagggcgaatcagaccctgccctttggcactggcctgctattacccagcatgagctcgaccaagagctttccgccggggaaagcgtcgccgagcagccacctcaacttccttatccacaaagccacgcccacgtggaaaattcaaccggagcctcgtcgatcgaaaccctcttcgacacctccaaacgcctctaccctgtcttgacgcggataccccaagtcctcccctttgctcagcgcgtgcaagtctttcacaagttgttggcggcggacaagcgacaggcacaggacgaagctcaactgttcgggcaccggatccggattcgccgcgcccacatttacgaggacgc

SEQ ID NO: 7739 - DNA, 700 bp, Nannochloropsis_gaditana
tggctgcaaggacggggcagagcgaaaaacaaaggccaactgagacaggcgatcctcgaagagctgtcgaggagaacacgcctaaaataggctagagaacctgccataaaaataaataaaatgtgccagagcgttgatgtgttaagtcttagagattgcgaaaacagggcgtggtaaaaatgtctcatatgacaggcaagcagttgcccaagtatcatcgccagcccttacgctatgacgtcgagcaccgacagcgacgtactgctttcaggcttggcgtgcatttgattttgtgcgcagcccaactcacgatccatgtttttattattgacactttttagtactacctcttcttatccttctcgaagcggcgggtaaggcaccgacgctaaattgagccgcttcgtgtgggaaacaacctttttcgcgtcaccgatagcgggagtacctgcacctgacttcaatgaatacttggctttcaacaaggcacaacttctggagactttcacgtcccaagaataggttacatagttatcagtgttctcgctcctttgcggcctctccgcctgccgaaagcttggcacccgccgggggcccgagggcatcagcccgccctcccctgggagggaatgcgtcctccaaaaaaatgtcggtgttggatttgttgcacaaaaaacgaaaaaatcaacgcatctctatg

SEQ ID NO: 7740 - DNA, 700 bp, Nannochloropsis_gaditana
ctgactccaggcttacaaaatggtacacgcataacatgcaaaagtacacgaattttcggtaccgagtaaattactcatcgcatatctcagcaatgtacaccacgcagataaaaaaatacttcaaggatcttgcgtgcacatctcattagcggatataagactgaacacgcttttgcacgcaagccatcctacctaccctgttttaagaaagttgcgatttttgtttgacaatatcagtagaaatgatgctaaggcctcataaataacccttgtatctccgttcacagcacagacgaggccattgaaagcctcaaagccatcctggtgcccgcgcccatggaatctcctgtaacacattcccatcagcacatgcgacactacgggatggacaccattgaaactatgaattatgatagagctcatcaaggagagcattattttcataaaacacactttggaagcaaccaaaatcacgtacagaagggggccatgtcatcatcggaaatgagccccaccaggaccgcgttgcccgctggaggcatttccggacagggcatgaaaaccattcagcaaacgccaactcatcatcaagactcatttgaggatgatatatcgagtaaattgaatcggcgaggatggtctactgaagaagatgcatgcattttgaagctggtccgcgcgcacgggaccaagaattgga

SEQ ID NO: 7741 - DNA, 700 bp, Nannochloropsis_gaditana
gcgaaaaggaatccagtaaagaccttctcatttccgaggatttaaatgtatagtttatgacattgtggtgggtcgatctgagtattttgtgccctggtaatccctgagagggtggtccgcgtgccgggctaaacaaggctagaggaggttacaatcatttgaaggagagtctaaccaacacgaagcgaccccattctggtactttgtccacacaagcttgatttcgaagatgaatactttacatttggtattgagagctccgcatcaggacgctaagcctatttttttcagggtgctgacgctccccatcctctccctcctcgaggcgcggaggaggcaagatattcaggctgcccagacccctgccaattattagacccgtcccacggccatagatcccacgttatttgtgtactcacaaggcggtctccgccctctttcgatgcatctatgcctattgacttgctcctcatgtcgttcacgggggtcgaactccgtttcaaaacattaccagcagactcacagggtcgtgtcacatagagtaacgcgctctcagcccggtggactgcgtcttacacgctaattgccgtgtataggacgcctccaaatgcaacaaaagaataaagggcacacaagatgcgggaggtggtcattgctttcggtggcaggcctagtagggttcaccgtagccctaggaatg

SEQ ID NO: 7742 - DNA, 700 bp, Nannochloropsis_gaditana
cgtattctacgtcgttttcaacagccctgtcccctgagctcccgccgccgcgccccctccctcgaccaccccggcccctgctcttactgctccgacgtggcactgtagcctgcgtctgcaaaggcatgtgtgggggcaagtccaagcgcaggactacgtgaggaagggtgctcaagtcccaaatgagcacgctgccaccttgcaggctgacggcagcatacctcccctggggactgaaggcgatttccgagtcgatgtcctccccctcaatgtcctcattccagatcctgagccaggcactgttgctcccgagcaatctttggattattggggtctcctcgatgcatcctgcgggcttcctcttttttgcgttgtaggttgtaactgatgttgacggacctgccatctctttcctgtcgagtggacacgtattaaggctttgaaaacacccaaaacaacacaagtacgacgacaatcaccctgcctgccttcaggaatacgtaaatgtgctgtaaagagttcagtactgcagacaaggtgatacacagaggaccaaatatatatttatcgtctctcctgggtcttggcgacggcagcgagcaaggggaggggtcaagactacggatgctactttccacactttccattcccacgggggaggacgcgcgaatcttctctcttcgatgccctcacccacaca

SEQ ID NO: 7743 - DNA, 700 bp, Nannochloropsis_gaditana
gtgatccctcttatgaccgcagtctttaccagcaatttcaactgcgacgttgctaagggtgcagacatatccctgcggggccgcccaggttgccggcttcccaacagctacttgagctcctgcagagatgggaattagggttcggtaacgacagtcagcatcgtcgatgtgcaaggctaccgctgtgccggatacagagacgacaaaaacgatactcaccatagaaactgagagccatttaagtaggtttgcttcaagtttctagcaaatgaatagcggagatgcgcttcccaacctcctgtagtcaacctttttcttgttcgaacgaggaccaaaatgtttctgcagccaccgtaaaaggacgattttccctgtaaataatgcaagaggtaggatatggtaatccccccccgcgaaatagagcacgaaaatggtcagtaagacgagggaatccacggggatccaggagcaggggggtctgccttgccaggagcggacggtcctcgcttgagcactcgccaacccctcgatgtccttcttcctcattccaccaggcacttacccacacaaacatccttgccttcacattggaaacagcggtgaagctgcttgtcgccagcggcctggctcagatttgagagttctgtcgacctttgcagtcctcacctggcaattattttctgttaaatcataggggatg

SEQ ID NO: 7744 - DNA, 700 bp, Nannochloropsis_gaditana
ctgcaaattctccggcattttcaccagctgccgaagccgaggtagcgttccccatacgttgcgtgtgaaatcctgtgctactcagttggcgcgtgcaatgacagctaggtacgcaaaagcctttcttgccttcgaacgatgatgcctgcggcgaggccgaaaagatgctagatgttactcacggctcttccaggcgacctaaaaatgtgacaggattataagtatagcatatcctgattcattaggcatcaagccgttggaaaaatagcgcgatgcagccgaggagttgacgctgtctgcgccgctgccccaaggaaaggaagctccccttttggcggcaacgtccggaggtcggtcagaccgttacggccagagacgcgaaaacggcccttgtccacttggaaaatctgagggcctcgaataaattcttgcgattcatttcctgtttgacagtgctcgcgtgtttaccaaattacttcgctccccgtaaagtgcagcctaattgtgcctgcatgcttcttgttatgttcgacaatacgtttattttctccattctcgatttagtcttgctagacactaacagagtatctatgctcctctcttttcatttttttaggctccaagcctttcttaagtaccgcaaatcgggaaaatccttgaaataaatatcccattcaatacgaaactctactacagaatg

SEQ ID NO: 7745 - DNA, 700 bp, Nannochloropsis_gaditana
gaaagtcgactttctctggtacttcaaaaagataacattcgcagcattcataggctatatgggaggtgtcggcacatatctcgctgttaaatacggtctggcgtcggccgtgagtgcagctgtcttacctatcgtatccagcgtttttgatggcaagattccccttattagtggcatgtagaatatttatttcacagaaaataacccacatattgcggtgggaaagctaataaatggggcaactgcatattaaagctccgattatagacatgccaggcacttagggtcagtttaaaacgtgcagtagtgtgttaattaaagtgaaaaatgtgcttcatgtcgtcataatataagctcttcctcgctgctcgcgtccattaaaaaaacatcgcagtatggaacgggaaacacagcgaagacacctgttttactttccctcctttgatcgtggactgcttgtagcaggggagggcgatgggagagcgcaggcttgtccgagcacgccccttcctcgccctccctctgtcccgcttcctcagaatgctcacactctcatgtagcctatgagaacagggaaacccctgaaattgtctccctgagtcgatgcacagatcctcatcaatctatcccatgtcatctgcgtcgacacagaagagcatcgcacagcacccttagtatcctcaaggcgacaaacatcatg

SEQ ID NO: 7746 - DNA, 700 bp, Nannochloropsis_gaditana
gacagtgtaccatcaagtccctcgcgccgcgaacgatgtaatttcgcacatgtatagcaagttgagcagtcagagagtgcacatatttcccacataaaatatacatttcgtgccggctcctgccattgtgtgggtgtaactgggagtataacgcccggctccgggagacgctggacgttgatggcatcctcggccagaagtgctcgctgagagaggcgctagcgcgctctctgtcgcttgccagccacgccgacaaaccatgtcccagccgggcactgccgcgagaggcaggaatagggacatggtatatgctggcaggcatgcatcgattggtcggggattgccagcgtagaaaggctgccaactgcagcaaggggaggagagggcaattcagcacgtgggagtgggcatacagccgcccagggtatttatgtcttcctccgcgctgccatccggaaaaagactggacctttttcatgtcgaatggtcacgacatgaagccggctatgaccgtggctacaggacagcatgctatgaaaacctcgcatgcgagacgcaggggcgagaaaaataagtgttgcgtctggaaagcaagtacacgctcgggtacaccctcgacgcgaaactaattttctacgtaaaattactccatacacataggttgcggtctagcttgcttaagagagaatcaagcctcatg

SEQ ID NO: 7747 - DNA, 700 bp, Nannochloropsis_gaditana
catccttgaaagataaacccggacttgagatattcaaacgtcttgatgcctgtcgaagagcaagtgtagtaatgatgggttgaaaaagcaacaagttgcgacaagctatcaaacagaaggagtcgagccttttgacggcatcaagggaaagcggccagcggtcacccgcaacactcccgcaaaagatttcccacaccagtctgttcgaccatcctgtccgacagctcctaaaaaagaacggcttctcacgttactaagcgccaagacttgcgtgcgcgtggacaggtgattccaaaaccaatctggcgaacgaagaagcctcaggaacaggaagaatatcgcacagcgtgcgtccccccaagccacacgcaagcgcgcactgcgcgtccaattgctgcctagaaacaagaaagggtcaaaggagtaatagaccggcatatctaagccccggtccggcctccaaaatcaattaaaagggtggtagtctcccgggccccactcctcgcttctgcccctcaacgggcccctcacttaccccacgcatcgctcactcctccgagacgacctcagcctggcgacagacatctcacccccgctcccccatccttgtacgcttagattttgaacatcgggaggggagcagcgggagcagggaatacgcgtccttgtcgttgcggtcgcgccgtctcccctgttgatg

SEQ ID NO: 7748 - DNA, 700 bp, Nannochloropsis_gaditana
gggatggtgtgcctttatcgcgtacttgcaggcatacgaagcctcggtatcgacagggtctgatgcgagagaggttgattcgttgaccctaatttaagccgtggctgtccaggttaggttaaaaagtccacgaaatatctcgtttgcaatgtctctgttttaaaaaaccaaaagagacaccgatttcccccacgttacttgttaagtgcgacgtaattcataaggctgaggcccaaggggatgaccctaaaactagctcccgggtcggcgaggtcgcccggggcgaaagacaaattgccgcgtctccaggcttcaagcagcctatcttcgtcactgcgaatttattgcacgcacatgcttatacttcaggtacggactatacgtagagacttccgatatattgtgtccagctgcagcctgattgcccgatgtcactctaagtcaggaaggtcccgagatcgacccacagccatcacatattacaataaataagtacagtgcggttttaaggagttagatgcatacaggcgagctcgatttacctgtcgacagacggtatacccacatattgaatccgcttgggcgctagcaacagcctttcttgttcaattacattacctgatgtcgacctccccgtctcatctttcgtcctttccgatggcacacatactaccttcaaaaagcagggatattcaccatg

SEQ ID NO: 7749 - DNA, 700 bp, Nannochloropsis_gaditana
ctgaaaatgtcctcccaaaatgctcatttccggccctcgacccgcgccggaacctcccgccccctcagccgaggccctcggggggcgggcccttctcaacacatcacgccgactcctcgtcctcagaaggccggacgtacatgtcaatatgtggtccacacagtcctcacgaatatacacgttcactcccgtgctttgcctccatagttcaaaagtgagacttgcaagctgaccgcaatggtgcgggcttgacatgatgtttgcctttaagctcgctcccggttggcgatcaggctggcacgctgttaccctatcttatttgcgcgagcaccgctgtccctttccggacaggtatatatgaacgaggcgagagtgccaatgtttgttgaaccttcgacgtgcgggcgttacgccttacatttcttatccggttatgctcttctgtaaggtgcggagccaagtctcgctccgcgtgtgccaaagcaaagtgcatcacgcgatcacggccacgactctgtgatctctttttcctttgtgttcaaagttgagacttacctccattgctccctcataccattttgctacaggtaaccccatcattcgctttccctaaggaggcgattgaagagccacttgaagctgttgaggcagtcaccgaagaagctgaatccgtccaaggccagctcttgagaacgaaatg

SEQ ID NO: 7750 - DNA, 47 bp, Nannochloropsis_gaditana
cctccacgagcgcactgtcgcctccccccccttcctctctaggcatg

SEQ ID NO: 7751 - DNA, 700 bp, Nannochloropsis_gaditana
acatggaggccaaccaggttgaggcagacggcgctcctgttttcccgctggttacaaaacagcccaggcgatgcaggccatggacctggacgaggcagcagagtgtcattattacatgcaggaataccatcccaaatgacagcattattttcgagtttgacctgaccaaaacggccatagggacaacttgacagccccttgccaatgcttgggtacgtgccttcctgtcacgtcgcgaattcaggacctgcgaacgtcctcacctcacagttaagagaacgtgtatccctgatggtgtggggtagggcgcagaatgagaggtaatgtcctccacgaccaagagagatggggtttatcaggggccagggcccgggagtttgaactgcgtcgtctcagcgaggcgctgactaaagtacagccttccccgctccacccgatgccttttctctccctctacgacctctggcccccgaagcctgtgcgatcagtttctttgagtattatcagcattcctttcttttactcaagcgccgatctttggggctattttcgaacaggaggcgaagctacaatctccacaggacttttcgtgaggcttctctgcacttcagaaggacggatatttcgacacagaggtgtcctaatcgcaatcttttcaccgtgaaatcaggagtgttaccaaggatctaaatttatcatg

SEQ ID NO: 7752 - DNA, 700 bp, Nannochloropsis_gaditana
aacgtaaagcggcgctctgaaatgcagaggctttcgtgatgagcattatcggaggtaggaggaggaggccgtatggagaagtcattgttcctcgagaaataattcgaacttatcttgtcgctgtgagcagtctgcaaagtccctgtcctttccttgctctgtggaaatcaagagtcggagaaataataattaccgtgctttcatctgcctggtggtgaacgaccaggtcccaagtgttgctgacggggtctgacgctcgctacgccgacgcttcgcttatcgtgcgaaagccttcaaccgcagggcacgaaatcagcaggcgaaaatattggtgactcgcccttgtcgtgagcatgctacatcctgggagggcctagggccgtgcggtcgcactggcattccgtttgttgagggtcaggcgtacgcgtatctcttaatacaagtcgcctctccgactgagctcgcattttcgttatctcgtcatcatgacccgccctcctcgatatcggcagcgacagtcagaaaagtgcccctataatgataggtgagatgaggtttatccagtactttgcgtgtacgcatttcaccctcctgtattctcacaggactttcatggatttgtctatccttatccgttgcccgtcaggtatgctcgccctttgacgaaacctgggacgttttgcaggccataccagtcatg

SEQ ID NO: 7753 - DNA, 700 bp, Nannochloropsis_gaditana
agagaaagaggctgcatcaaaatgtggctcgagcaatggtgccagggctggatctcgacgtaatgacacaagaaaagcctttccatttccatgtccagggcctgccaggtgagataagtcatcgtccaaacttttcggattacttaatggcatccgctttggcgaggagatttcagaagacatggtcatgaatctaaaatagcaggagaaagtatcaggaggagtgagaaggagaaagtgagctacagagtttgaacagttcagggcagggtgggccatgctgccgcttgtcgagcctcctggggcagaaaggtatccccggtctatcagggtggaaagggctgtcacatagcccaactcttgtactaagaagaggcaaaaatagcagcaagtggacacctcagtgttgcattggggatggtaccttttcccagagtattacgaggccagagacggctttctacgcccctcgcggtctgctcttggcgatgagggccttcaagacccgggggcatcggttatgtaccacaacgtttgtgtaaaacaaacgggcactgcgccatgttgctgtctcaaacctcttctaagtgtattctgacttgctggattctatgacagggctcaaaggaaggagaagcacgaacgagcgcgaattcgtcacctattgttcaagttcctcttgagaacgactctaaacatg

SEQ ID NO: 7754 - DNA, 700 bp, Nannochloropsis_gaditana
aacgctgcgattgatgcacaagacaatcaagaaggtgacgcaagacgtggagaccttgtcgttcaatacagccatctcgaccatgatgatattcgccaaccacctggctagccggaagacggaaaccttgcccagggcggctgttgagaaccttgttctcatggtttctcccttcgcgccccatctaggagaggaatgctgggagatgcttggccacgatcagtcgctggcttgccacccgtggccgcggtaccaggaagagctcaccgtcgatgacgtcgtcaagcttggcgtgcaagtgaatgggaaaacgcggggagaagtgtcggtccctgcggatgcgacagaggccgacgtgatggcagcggcgatggagcaggagaaagtggcttcttttttggatggcaagagggttgtgaaggtcatctatgtcccaggccgtatacttaacattgttgccaagtagacgaggcccgaatctcgggctgtaccgagaaaggctcgcgcctgcaataggaaggactggtgaaagtgcactcaaagggagtagactgatcgcatgaaagcaaaaaccaaagtcctttcgtgatggacctttgagtgacaaggcatagtagatttttacatatcggtataccacgtgagaggtgaagtaaatcggacataacggacattgatgctactggcgcttggacaatta

SEQ ID NO: 7755 - DNA, 700 bp, Nannochloropsis_gaditana
aaatactcgcgaacgtccaacgtggcctcgtcaactatatcggtaaacttttcttgcaatttgaaggcttgctccttcacctgtaaggccctttccctcaccaaatggatgccttcctggaagtcttcgttgaattcctccatgctatctctgaacaactcgaaagtcgtcatcgcaccctccgtttcttccatttctggcatatgttggtcttcgcctctcaagttttctttccccccaagcctttccgatgcctcctcgacggcaagtatgcgacaaacaaagtatgaaaaaaagacaatacacagaaccagttgatattttctgatagccgccatgatctctatctcatctctgtttcaaagacttgctgttcctgtcctgtttcaaagttgtactgcgaaattctcggaaacctcctacctactagcacctttctgcttgcagtctttgtccgcgttgaaagtgatttctctgccaggcagtggaagaaaatgtgaaaggatcgtgttaagatacatcgagttgtataatgcgcactaaacttctttagcgctcttggcatgttccgagaagtgtgttgcaagcttcttccgcgatcagcctcaggctagctcgcccagccgaggggggtcgtacgtcctcagtgatagtccttctcacctaataatgcaaacaccatcattaaattatcggtagc

SEQ ID NO: 7756 - DNA, 700 bp, Nannochloropsis_gaditana
ttgcaaagaggggtggggacacagaatggcttagaaaacgcccaccacttacattttttctgctgctgcaagcaatagaaagggagacattaaattgtcaaggacactcaactcgcctgaagcgggtttctgctctcggagtcggttctgaagcctttgaacagccgcgtgaggatcttgggtagccagcgcggcaaaaaatcgcgaactaacaatcaaatccatcacgatttcgatcaaatcgtacccacatttaccgctactgctttccatgtcccttggccttaaagaaagtttgacagtgcgcggatttagtccacgtggacagcgtcaatttgagagcggacgtcaacctcctcccaaaaaaagacgccgcacatgacgaaggcgtggagtcagtcaaatttaagcgaagtcgactgctgaacttgcgaagcaggttatcggtggtaccacggcatctgaaacagtcgtgtatggtcttgttaaatcgtacgcactcgcaaaggtcatgccgccccactgcgtgaaagaaacgcttgcccctcgctcgcgcggacagtgctacctgaatggaggctttttccgaagtatcttcacgttttatcctcgcgatttgcattttttgccacgaaaatgttatccatagtccagacaggtggctgactgagagacgtccttctgtcgggcgggggggatg

SEQ ID NO: 7757 - DNA, 700 bp, Nannochloropsis_gaditana
tagacaagaagaaacgcctatcgcctcaaaaagcaaaattttgttttcccatttacatgtcttatttgcatcagacgaacacgacaatctgtgatgttgctttggtttgaagaacttgacggtgggtgagatgcgtctcttcagttttcaaatttttttgaactctgcctcgaccgttgcggccgttagaccggcgaaaccgctaacgctcgtgacgcttcggttttgcacctcttcgacaaaaccatttgatgtcgtgacatgtttgcccatggtaaatatttacatgaaaattatttcacaaatgatacttcgccaattttccatatttaagcatagcaaaggcacaagtggcttgtcctcatacttcttaattgttccttttgtaccgctactttatagctttacgtggctcaagataacgtcctacttcctaacatatcaactgtttctcgaacactccgtgctatatctagctataaaatggcatccgttgtcatcgcgcatgcgttgttggcgacacactgtttgagcgcttcttgtaattagagttctccggggcgcagacaggagtgccctggcatacttggatcacgcgacgcgtggtatgctaggtccacaaaagaaatccttctttcaaacttctcaaatctcaatgtctctctcacaggctgattatatatcgttttaaagccaaatg

SEQ ID NO: 7758 - DNA, 700 bp, Nannochloropsis_gaditana
gggtcgggcggccctcagtggcgttgcccgctgtcttcacgcgtggccgcgtccgatgggcgtgcttacgaaatgtgcagtcatcgcgtagactctcgtgtgaaaagcgagaaggagtgggttatgtcatgtatggtcgtggctgggggggcgaggagcgtgtggctgggtgaggcgccgacacgtcgcccttccccttcaaggcgttggcaagtcgttagcaggtgccgccacggcgacatggatcctcgacctcacgctgttgttctgcctctcacggcagggccacattatctgaactacgagtgcaaccttgtgactccaaggcacgtttttgaggccattcgaaccccagtttcgggtcggagggacggcagccaagaggttggacagtggctactcggcgtatcgtcgcgcgagctaaaatcttgattccctccctagcttcagtaacgcatcactttgtcccatggctgaacgtttggagttaattaaatcttaaaaggctttgttgatgtaagcctaggagagctacgtcgtccctcgggtcccaacatgtgttgtttgtgcgtgtgaatcggaggttcctgaagatcctcgcgacctcagcacaatcttcgctgtgggctacaaatacaagtttatgtacaggttttaaacgtagctcttgacttcactctttacaactacagtgaagatg

SEQ ID NO: 7759 - DNA, 700 bp, Nannochloropsis_gaditana
ccacattacgtctgagtattaggtgaaggctgtgattttagcctgaccgataggcatcactggatgcacatgatgcgagtgtacatccctgggaaatggtgttgacgggtgcatttcccagatgcagagatcacacaatttcctttcactgtccttgtgttgtagatcctttaatctttttcatacgaacttgatctcaagcctattaaaaatgatttttttgatttttttcacgctatccagccttcggtagacgctagagtctacaaggaatttaatcttctttctttcgtcaacgtgtccagacagatgcagctggcatccctcaaggttggactttaggatgtcatgagcagaagtgacgaaaagggaaacgtcaatgccaacggtgcaagcatatatgaagcgtaaagctctgccaaagctcctgagatacgcttttggttttgatgtcattactcattgtgccttttcatatgcctttactatactatatccgaaagaagtagtgatataggttacgcacatgagtcgagcagaaaagttgtgaactttagcggcagggacgcaaaccaatatcacagagggcaaaagaatcgcttatacgatttccgtggcggcggatggaccatacaaggacggagcagccgttttagcccatgctattcgcaaggcggtgaaagactctcattacagcatg

SEQ ID NO: 7760 - DNA, 700 bp, Nannochloropsis_gaditana
gccgtcatcggggtcaggactgttaagtcatggaggggttggaggagtatccgcacccaaatgcggcgccaagcacggtgggcagcaacaaggggggccctgtggagttcaggaggagcagtcagcggacgttgctgcatcactgggagcgactcgaaagggaatacttcaggcccgcgaccatgcaagacatcataacccttcatgttcaggtatgttgaaaaatcacaagaatgaatgtcaggcactgctcatactcttctccaaaaatcctcagctcaagagcgtgcaacaaaccctggaggaggcggaagcgccctgtctctaccggaagcgtcttgaaagcagctgcgacgaaacctttccttccaggagtatggcttacttagataagagacagctatcaaataaagcttcgcgacgagaattgttaatgagtggggtcgaggatgttttggtgacgaaatcaggatacagccgaaaacgcttgccgtcatacgcacacctatcacaaggaccgccctctgacagctcagcatccacatctcattgctcttttagcgacaaggagacaaaattcaaaaggtagatctgagagggagcgtggcgttgttttagtcgcaatgaaccttgccccaagatgtgcttcagaattacttgcatgcttcatcgacacctgactctgcacacacgcaggatg

SEQ ID NO: 7761 - DNA, 700 bp, Nannochloropsis_gaditana
tttcgctggaaacggggccgcacgtgaatgtcgattgctccttgagggaggctggtttgcctgtttcgctcttccttttggcccaccatgttcaattacgctcactacattggaagtgacgtgcagaacccgagtatgagcacatttttgtctcggtgcttgtatacgccatgtcatggaatgcgcatccaatgttgccttcgaaaatgatatttcttcggcatgattaaggcacttctcacaggagcttcaacgggttgcggtccctattaaattaagccttccgaagctaacaacgaaaagggatattcaagcacaggattgatcgatatagtctgagccatcatggcaaccaagccatcctcattacgtgagcaggagcatcatagccctgaggactcggtggtaatgtttcaacagttgtcaagctgtgcgcaggcaagcttctggcaggaaatggcgaaattaaaagtagacgtacttggtttagaccagaaacccctggccattacggggacctataccgcgacggggcagaattcttcggcttccgcaagtattccagctcggctttcggtcggaggtgagtcttggttggcatccaaagccgagataattgcagcgggaccgtctccaggaacgaaagggcaaggagagcaccctcgcgcttccaacttgacgaaagattgctgggtgccgg

SEQ ID NO: 7762 - DNA, 700 bp, Nannochloropsis_gaditana
gaaggccagccgagataggggataaaaaaggttccggtgccaagaacctcgatgccactgaggagactgtagcaaacgccgtgcccagatcatgctattccgtgccacgggacggtagcggtatagaataagaagactgtggcttatcggcaccctttcgacgtttgtcggggaagccgaagtaacgggtggcttgccctctctaagctctgtatttggtgcatttgctttgcgagcctgggaataaatgttaaacttttgagaaatgttgtcttcatgagtgaagttacctttttgcatgccgtgctgacactcgtttgcttgcttagacgtacgccgcaattcaacctcctctatgtcttcgatctcccttctcactgtaagcgagtactgaggcagcgttcagtaccaatatcatgctgccgatccacaaagacgactgtcgtgtgcattcgcagaggcctacatccgttgtcttgtctcagtgatgcaattcttagctggttctagcccgctcatgtgtgtctttattatcattaagtactttctccttcacctgcacgatagatacgccggcagcaaggatcgactcagccgttgttgaactgcaaaccatactaataaactccatcgcgcccgcaaacccacgccaaattcaactggaaaagcattggcagggatgaaggtgattgcattcatg

SEQ ID NO: 7763 - DNA, 18 bp, Nannochloropsis_gaditana
cgtagcagccaggacatg

SEQ ID NO: 7764 - DNA, 700 bp, Nannochloropsis_gaditana; identical to SEQ ID NO: 5184

SEQ ID NO: 7765 - DNA, 700 bp, Nannochloropsis_gaditana
cgagggaggggatcggatcgatcgatccgatacaccgctgatagctatccttggagcgtatgcacctttgccagacttttgggcgtctctattgctcttgtacaacgcattcgttataagtggtttctatgaatagggctttaaatttatcattgtgcacaattgtcccacttgcaaggccttgtttttcggggcggttgcagtccaaagagaagggcaacgtcttgaagcgctttctgttcattgttcttattggactttcccgataactacagcagggggttgtatcccggttacgggcattacagaagaaaaccggcattagatgtctgttccgaatgatgaggaaattatgccacgcgcagatgaaccctcgacgttgacgagaagtccaccctctcaaacgagtcaggccgcccatgcttcattgagaccaattcaaagccagttttcgggtgccacgcctgtctggagaaagcagcgatccctgttgatacttggagcatggatggcttttgctggtttggtcatcctgggactggtgctcacgatatcacacaatgaaagccggcgtcaacgcctcctggagagagggagtctcccctcccgagtcatgttgggccctcccccatcccaagacgtgccaattttaggaacccattgctgtaccaccgagtacggccttgaggcgtccacgatg

SEQ ID NO: 7766 - DNA, 700 bp, Nannochloropsis_gaditana; identical to SEQ ID NO: 5183

SEQ ID NO: 7767 - DNA, 700 bp, Nannochloropsis_gaditana
tgcacggtgagtacagtcaatcttccgaaaagaggcctcttgcatatatagtgcttcctttcctccttacattaaaaagttgagaggtgagagcatcaatggataaaaatgtggagagatgcttgctgacgtcagtttactctggttacatttgcgaccaaagcaatttgaaagagagaggggcacatttcgatgtgaagatgaatatcttgatttactttatagaatttaaggatattgcatccgctaatcacctggtttccaaaatctcccaaacgccacaattgttcgcacacgtacagtttcttcagaggtagaatgtgtggtgaaatccctttgcataaccgcatccgttgaaattctggatatttatgccttagtaggacctatggacacatttgattatcgacacgtcaccaaagtccaaggtcgtccagttgagggtctacttggcctgtacagcttttccgtcgatgccaataccattccgcgtgaacaagtgtggcagatccagcttaaattgtcgtctaatgcacaacaaatcacgtctgtggatatacatgacttcagcgtaattattgacacactaccaggatctggctccgtgggtattggggggctgccgctgtcaaatacaacgacgcgtctcggggacttgaatatgaacaagagcaacagaggggcaacaagtacctcgatg

SEQ ID NO: 7768 - DNA, 700 bp, Nannochloropsis_gaditana; identical to SEQ ID NO: 5169

SEQ ID NO: 7769 - DNA, 700 bp, Nannochloropsis_gaditana; identical to SEQ ID NO: 5171

SEQ ID NO: 7770 - DNA, 700 bp, Nannochloropsis_gaditana; identical to SEQ ID NO: 5172

SEQ ID NO: 7771 - DNA, 700 bp, Nannochloropsis_gaditana; identical to SEQ ID NO: 6619

SEQ ID NO: 7772 - DNA, 30 bp, Nannochloropsis_gaditana
tatgtgctcggattgaaaggaccgagcatg

SEQ ID NO: 7773 - DNA, 700 bp, Nannochloropsis_gaditana
gtaacttttttacgggatataattacctgtggtcttggttatgcttaaaagccgcgccaatgattataaggagtctctcgcatagtgtctctcacattcagaaacctttattttttcattgaagttcttctaaaaagtaaatgtttcacaacgtatttccatgatggaatggcgaccattttgggtgcaattcgagagcttagtagaagcgtgcagccgaggttcaaaattttaaaattcggcgagggcgttcgcagcatttggagcagctcgtccctcgccgaccctacctgtggctgtgacacttgccaggaggtccgaggattccctccatcgttgtgggcaaagcaagttttatgttcacttcatgattggacgtcctcaggtctcttcctttgggacttaattcatcttgagtgctcagagatttttttttcatacagtcgtgatttggccaaattattgatcaagaaataatttgtcgcagctttgtcacagtttttgcttcacattgcctgtcggctttctgattgacagcgcggcatagacgaacaacacaatcacggaatttggaaccactcgagtcgaaaagaggaataataaggactttctgaaggctcctatatttatttgctccatgtcgctcctcatgacctaccactctatcttaccaatcacgccacagaaggccctctccatg

SEQ ID NO: 7774 - DNA, 700 bp, Nannochloropsis_gaditana
cgtggttgacgttgctgtacatcagtcaccatgaggacgaggcattgcccgaagtgacctcgcacgttctagagctcgagcgcggtcgggtgtcgtttgccggaaagtctgagcagtggaatgaactggcgttgaaaaggcggaaggagcacgaggcggggggaggaagaaggggggaatcggactcagtctagcttgagcctcagagtgagtgagtgagcgcgcgtaatccttacccgaggcgcggcccacacccggcgcacgcactcagcatgcgtaaatgggaaaatggctagcacaaatatttctgccttgttgataattttgtgtacgaatgaaaattgcggccgtgtgtacagtacgttccagctgttgttaccgctttccaaactacaccgatgggagcgtggacattgtttttcccccgatagtttctttcgcattcacaatatctgggcccaatagtgcttcactttccaacccatcgcgccgaaaagagcgtccaaacttttctttgtagcagtgccatcatgagggctttatgtcttatgcgtaccccccgacccttttcgcggaatttttcccgagacccgcccggccttgccgccactcatccccagatacgatacttagggtctcgcggccctggcacgcttactcacgcatgttccgaccacattgatgcgcaggcgaaatcatg

SEQ ID NO: 7775 - DNA, 700 bp, Nannochloropsis_gaditana
caaattgcattgcaatggataccaatgattgttccttccttcgcagactgccgacattttttttgaacaaggaatgcaaatcgctgcccgctatacaaattgtatcgatgatgatgctgcgatgatgtgatggaaagaagacccgccgaagggatgatgaggaccagacagcccaagtgatgatgtgatggaaaaggacccatccagccgagccgtcagctggctatttattcccgggggaacagacgcgcacggtacttgcactcacgcggcggacgtgacgagtgtgccaccgagcgtcgcacgcatttgctgttcatagttatcatctttgtggagggtatttaagcgcttgcattgctgattaaatctgcagcggatgagaagcagttttcctgggtttgaggaaatgcaacatgtacgcatctgcgcacgaaaaaagagaacatcaggcggctacttcaaggagaaagcatatctttaagtcgcgtatcaaaaagaaaggacaatacagagagagaaagttatagggccattaggataccgttgtgctatgcgcgaggcagcttgcaagtcagcttacaatgtttcgccgtcggtaaacaccgcttaatacggcatcatgttactcgaagtccttcctcattcacaaataccacttgtaaacagaccgccgatataaagcattttctaaacaatg

SEQ ID NO: 7776 - DNA, 700 bp, Nannochloropsis_gaditana
atcatcgcggacacgagcaacatccaggtccccccgcgctatcttggcgagagcacgccggcctcccccaatcccatgtccagagattgggccttctgccgctatctgactctggaagcaggcgtggccgctatacccccctctgccttttacaaggaggagcacaaacatttggcgaagaaccatgcccgctttgctttctgtaaggcagacgcgagcatcgtggaggccaaggcgcgctttctgagatggagggggaaggacgaggctggcgcagtgggtctagagaacgggaatgggaaagaagaggcttgaagtggtggttggatcggaagggaatgctttggacgagtggcgagagacgaataaattccgcaggcgcgcctgtcgcttgaggcccgtgtgccgtgcgggttgtttgcctcgagtttggggtcatgcaggcccaggaggccgccctcccgtgaaatgtgatgaaaaaaatgatttgccgactgactgtacaagagctccctttatgccagccacaattcctgcaccattctttgttgtccttctcactctaagcgttacttcccccttgcaccacaggcgcgtgtccagccactggaaagggtcgtaacctcgatacaattttacgctctcaggccatcgcctccgatgtagtgagatctgaagatttttgcttcgcagtggaatg

SEQ ID NO: 7777 - DNA, 243 bp, Nannochloropsis_gaditana
tgatcccggcataagcctcccaatgcctaacattgattaggtgatacggggggggggagaaggggttgatgagtattggattgtcttttgaacacccacctgctgcgacgagcatcgggatccgctgctactccgtctcgctatcgcccacagcccctcaaaaagtggtcactgttacactcaggcgatctctgcccacacggacacacagggcttggcttggactggggtgcgaagtgcatg

SEQ ID NO: 7778 - DNA, 700 bp, Nannochloropsis_gaditana
gaaggcgaaaaagaagcggaagagatgttggtaccagacacgtgtgttgtctcaaagtttggccatgcatttcccgtttccatgattcttgatattgcggtctccaagcgcacaatcaagacgggagactccatccaaaactcccgtgcccactgttgggcttagttcacgccgtgcgcagtcacatagaagcctattgtaatgaacgctgacgaagcgcgtcacgcaagagggctagtgtgcatgtggtagcttcaagtcaactcggcccgcgttgtggcagggagggtaagacgaaaagcacgcgagacaggtcaaactcaaacttggacaagaggattacccatcccactgaaaagcactatgttgatgacaaagatgaggtgtggccacgggcaggatagcttggtgtgcgccccagcccgaccggtactggttttccctgcctccggagagagggctgctagccttgaagaaccggcaagaccgcaagcttttcgcccgtccctcccgcctgccacaagcctcaagctggcgccgtactgccgtcatgcattcaaaaaatgctgattttttcccactcactgacagacgagccggggaacgggcgttttggctccattttctccatgtgctgaagcgcgcctctcactgcacgctatccgcgctaccataatacctcccctacccccccaacatg

SEQ ID NO: 7779 - DNA, 700 bp, Nannochloropsis_gaditana
gccaaggctcaaacccgctggcacaggggcagctcacgtgccgagagtcaccactgcttgcccgtcacgacttttgaacttggtcacctgcaggagacacctcacatcaatatatgcggatgaattctcatctttcgcacagccgaccaaagaagctctcaggcaagagcggtcgatggacgacgagacggcagacccgggtgcgacagctacgtaccatgcagaggatgtgcgtctcctccatcactatattcggtctctcatcggacagaaactgtatgactctgcggatttgattggtggcttgctgctttgttgtactcgccccgcgatcatctctcatagcccttctatgtgggacctccatgctacctctctcgagctttacgccgattccttggttgggaaaggtgaacgctatcgggccctgtctttctaccagcaagctaatgcccaccggaagtgtgccgcctcctcttccctacggtgctctccaactcaactgctcggccttccccccacatcccctccttgcccccccccttctctgcccatcaacttcaaagaggctcgctgtcatctctccctcaacaagccctcccaggccttacgggcgcttctttccgtgtccacctcgacaagagaatcgtctgttccagtggcagtcaccttgggacacgtgtaccgccgcctcggaatg

SEQ ID NO: 7780 - DNA, 700 bp, Nannochloropsis_gaditana
  misc_feature (1)..(136): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtcctttaaagggtggggaggagtactttctcaatttcacaagaacagcttgggcgtgcgaccagaatgcttcgtctttccagccgcctggctgtaatacctttgctgctcacagtcctgtgcgagcgatcgacagcatgggtcggaccaggcctggcaagaccttgcgtcacaggctctttcggttcgcggattcaaaattggcatcttcgacctgaggagctgccgccgcgacccagtttcctcactctctcctctcccctggcctccgccagtgcaacctcaggctccgaaacgacaacctcgtctcctgcgggcgttcccatcacgtctcccactacgaatccaccgccttaccccgctgtggccgtccggcagggtttttccgacttccgaagtgacaccgtcaccctgcccacacagcaaatgcgaaaggccatgtccaaggcggaggtaggggacgatgttttccgggaggatcccaccgtagaccaattagaaagggaagttgcctcgattttgggccatgaggcggcgctttttgtgccctcacggaccatg

SEQ ID NO: 7781 - DNA, 700 bp, Nannochloropsis_gaditana
caaccccccgcaaaagcttctctagtttttccagcccagccgtggctggtgcagaagatggattcatggaaacagcagtgttaaaagatgctagagcctttgaaaaatctccactgatagcataggcctcccccaacttggtatgcaagaaatcatgcccactattttgcaaactactcgacaacagatgtatacatttatcgtattcctgtgccccaagatgcaagtctgccagggccaaaagggcatcgaccgtggacgggttcatgctcagggccctttggaaggcacgcttggccttctcgcgcccctccggcaactgggccaggacgcgacccaccaaggtgatggccgtggcgctctttggcatggcggaaaaggcttcctttgcacaccctaatgcctctttaaatttgtgttggaccaaataggcgtccaccaagcctttgtagccgttcatgtctttgtggagccgactgccctgaaggaaggacgaagccgccgcctccgctttccctaacgcaagcagcaacgtgcctcgtacctggtagcctaggacatgctcgtgatccgtcttgattgcctgctccaccaacgtcaaagggctctccttctcccccttcaggtcgctgtgcaaggccgctgcgatccacggctccggccgcctcgtgtccacatccatcagtcggtgggctaaatg

SEQ ID NO: 7782 - DNA, 66 bp, Nannochloropsis_gaditana
gaggaggaggaagaggagggggacgaaggtgatgaagaagcagcgaaggtggaggatatctgtatg

SEQ ID NO: 7783 - DNA, 700 bp, Nannochloropsis_gaditana
ggacagcacctgtatatctcgggaacaacgggaggacattgtcacagagcgtggtactggtgggttgaaaagcaccacaaacatactccgagcgcaaaaagggcctgtaaaaagatttgccggactccaaaaagtggacaggggcataaagtgcttcatttttggcctcgatgcacctacaaagccagaggacgcggacagtgtggtgtgtatactgtggcatgtgggtaattcgatcttcaggatctgttcccgtcgggcgctttgagcgtgcgcttttaggtgtaaaggttccttgacttcccaccgaagggcatgtaaaacgtgcatacatattaaaggaagacacattctcttggacaaggaagtcaagagctggtttcctcaatgctttctaaacgcgcaatagaagacttaaatgctaactagcacctcagacaggctgaggggaagtcactctttatcaacgagcatggcaacgaatgattatcggagcaaaggtccatgcgtgctctcatgctattgccatgtcgtattgcttgagactgtgctgaatatacccctcggtgctctcctccgccgcacgaaacttacagcgtgcggcccccccttcgtaccttgaagcctcgctttcatctcacctggcatctcattttccatttaacgaggacaaaataattcacggaatttgtgcaagatg

SEQ ID NO: 7784 - DNA, 700 bp, Nannochloropsis_gaditana
acggccagcattgtgctgatcgtgggaggggttgacagccaacccaacctttcacgcgtgcctctagtcgacaaaccaggaacgcataagaaaccagtgagacagcttgcaaacgatattatggcagatctctcaaaggtttcataaacaacgctccatcacgctggtgtccaccagaggtgtccaccagagtccatcccacaacacatttaagtgcccgcaggccgcgtgactcgccaacctcagccttgcaggggtccgaaaaagttcaaattccccattcccgcctagctacgagacgtgttgggaaaagggcacaaggacgaaagagcccgagggcgtttcggtccacaaataaggaggagacctcggtctacaaataaaggggagatctcggtccacaaaaagccgcgaggtctcacactatgatggaaaagatgcccgagtggtggaatgttctttgaccacagaggaagtttgtcgactttggagcgactgggtgagatatggatttggacgcaatagtcatcattttgagggaaaacgactgggccgggaaaaatgactctttctcctgtattttatttggcgttctgagattttttcagcgctgagatcatttccacctcccttcgtttcagcatatttgaagcccttcaggtaacgacttggtcttcctgtccgtctcgattgatccatg

SEQ ID NO: 7785 - DNA, 700 bp, Nannochloropsis_gaditana
attcatgtcagtgtgcatgaacctgtctttcgagatatacatgctaattgggcgccttttagtcacgaaggacgagcttcgcaccatggcgtgacggtctttcagggtggacccgtctttgcttcctgtgttgtcctgctctcttattccaccacgccccccccttttcatgaagaattgcgagatggcatcggttttaatttttgagggagcgaatagcgacagaaagctacaacacttgcgggcttgttgatcgcaagctctcattgccatagctttgtgcggtatcacgtgtaccgacctgtcccctccttccgcgatcgtagtatttacattttcacacacacaggattcaaaaatcgtccttccattcgctcaacagcgcaacaccgtgtcgctgctcttcttgaagactcttgctcatagtttagtcgtgtgccttctgctgttaagccgtgtcggtacctgtgctttagattccggaggtgccgcccgtgttttttcacgtaccccttgtcgcctcgccccccgcgtcacaaaagccgctgcggttgccgctacgtttgtcaactcgcctcgttttcagtacagacaagtcactcggtgccaccggccctcgaaccgagtcactgctcccctctatattgaagaagacgctgcccctcgccgccctttcgacatcgagctacttttccaaatg

SEQ ID NO: 7786 - DNA, 700 bp, Nannochloropsis_gaditana
cctgactgtggtgccccgctaacggaataaatcgctgctccgatctctctatcacacgtgatttcatctcagatacatacgctcttgttccaatcctcacagggaagaacattgctggatgaatttcttcgcgcctgtgccaaacatccctccgccagcagtttcccctagcagacgcagacgacctcgaccaccacgcctcggcgctccgacacggacatggtgcgccacgcaaatggaggtcatcttcaacctgataggtcgcttaattactagttctttccctcctgcaagagaaaatgagacgtctgagaacaatgctggcagccatagtgaggcgtgctggcccaacgtaggcttttacgcgggcaaaatttattctaggagcttatgcagagcattgggcccagagccagatgcgccgactggaattttccgttcttttacaacttcgtttggctcttcgttccaaaagtcgtcggctccctggtaccatgttcggacgccacggcgctctgtgattcttagcaaggaggaggaccttcagacctggatgcaggagcgtcggcggcgctcatgggtattgattgctcgttattggggaggcatgattgttttgaacgtcttctttctcataaatccccgctttcgtgcccttgtcgaggatatgctggatttattttacacttctgcggtcatg

SEQ ID NO: 7787 - DNA, 700 bp, Nannochloropsis_gaditana
gacgtttcttgtgcgcaattttcgatggttggaggggagatgcgtgttgagtttataccaatgaaattagcaaccctacgagactcgacgtgggaggcacgagatactggggctgcagcacgaagtacaccgaacgcttttattcctgcctcccaaatgatgggcaaacgaacaaggacacactttttctcaaagaaaacaaatgattaatgcgatgtcgcgtgcagctccggtgttgggttttcaatgaactaaaccgccttcgatttgctttgaggtcggtttatcacgatcatgttcctgcccactgataaatgcaaaccaagaatactcgtaccggaacaatgcttgaccgtgagcatcccattgctttactccgttcgcatccaaggaatgtacgtttgtgtgcgcccttagaacttcgtgtctcgctcaaaacaaaacgtcggtgtcgccattttttatccccctacccgaggagcggcgtttcggactaggagcgtcgaacgtaaatgctgttttttgcacgaccatttttggatttttgtccttttccataccgtgtgctccactcattccgtgcatatctggtctattcaacaccacagggcggactatggatgacggggacccgctctcgcatcctgccattcagctgcaagtgtctccccccccgtctgccgctaaggggagaagcagc

SEQ ID NO: 7788 - DNA, 700 bp, Nannochloropsis_gaditana
  misc_feature (1)..(660): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccattcctgtcgccgccgtctctgggtccttcagcctg

SEQ ID NO: 7789 - DNA, 700 bp, Nannochloropsis_gaditana
  misc_feature (437)..(577): n is a, c, g, or t
gttaggagacgagggcgagtacactgagaggcatggctacgggtgcctggacggactgcaatatttatttaccctccgccgtgggctccctacccttccctgcagctcttggtgatcaagacctccgaggaggcctggggcatccccgacgcgaccaagatgttctcctttgggaagttcacgagtttgaagggggtggaagggaactacagtgtgtgggagctcgccctcttcgtcctgatcggctgcgtggggggtctcttgggggcattttttaaccggagcaacgagcggttgacgcggtggaggatgcgccgtctccaaccctctccacggagacagtgcctggaggtggtggctgtgtgtgccgccatgacctttctttcctatttccttcccctctgttgggtgaaatgcacgcctttgccctcctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggaggaagggagggagggagggaggaaacggacgtggtcggctccaaaagatggtgcgggcctccctgtatgtacctctcgtctcatcttctccctcgcgtttgatcaggccctggctatg

SEQ ID NO: 7790 - DNA, 700 bp, Nannochloropsis_gaditana
ttggacatattgtgacgagcaagatgccatgatcggggcgacttgatagagtattcccacaatagtcgcacggtgtgggtgccctccttttcacgggaggcaggaggttaataaagaaagattctctcatccaggtaaggatggctaaaaaggtttatctcctcgtagtcttacacccgtgatctacacatttatcacgctatctaccaagtgcaacgccgaacactatgggccatttgtcattcgcatatcagcatatgactccgcagacgagcttcagccgtcacgttcatcctgaaaatgtgaaaggtagccacttaattatggccgcgcgcagtgttgatttattaccatttgttcaagtgctaattgataaggcataggcatctccggtgcttctttggtgtcgctgtcgtagtgagcgactcggtcactttttgtaagcgaggcgacgtacttcgttaagtcacacccccatctgagattttggttgtaatgaagctaaaagaggactctgcgtgaattttaagcgcctcctctcaatcttgctacagcttttctggtcctttttatgacttgttccacatcatggcgagctccctctgtctgttgcattcacagatagccttccttgcttcctcctcgcaacgcactcaacgcatctaccttttgcaacgccttaatacagactttgtgcatg

SEQ ID NO: 7791 - DNA, 700 bp, Nannochloropsis_gaditana
cttccaaaatgacttctcttcatgacggaacgaatttctttacacatttggaaaacgacacaaagtgtggtcatgctctagcaagcgattcactccttgtccctgattagcgcaagggcactctcacaagacagaatcaactgaatcaatgaacttagctgatttaaagcacataacttaaccagacttccagcacattcgcgtaacaacctttattcttccaagttgttcaacttcacatggaactcttaaggtgatggtggtgccccacgcccttaaaaggcttcgacaagacgtcttaacctccccaccccggtcgatgccgtcatcgccgttcgtcgttcgttatatgggccccggaattgaaacaaaaacacgataactgctcgtgcttcttttttgcaccactacagcaagaaagcgccaaaatttcacccttcacaccaaattaaatacacactctacatctttgggttacgatgccttgcattgtgaatcacactcctatcccaaaaaatgtgctacatgtttttctggcatgaaacgccgatacttcccttccttccagagctgcttctacgtgatggcccgcatgatacgtacgcaacatcctcgcatcatttgaaaacttatcaatatttaaattacgcattgttattaagtgtcatttccattacctcggagatcgctggcagtcatg

SEQ ID NO: 7792 - DNA, 700 bp, Nannochloropsis_gaditana
  misc_feature (1)..(95): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccccagcctgtacaccctccctccctccctccctccttcccctaacaacctcacagtctctccacccaacccgtcccttgcctcgcctaccgtcaccgccgcatcagacacgtcggtgcagctaccttaagagatacgagccccgtatcttccacctcccgcctcgccctcttcccccttttccgtgggcttcaacggcctcaaaatcccctggtgagcacctctcacgttttctctgcctttttgagctcaaggcgtcgctgcacctccttcccctccatcgattcctccccttcctcctcctcctcctcctcctccttctcctccttttcctccttctctatctcctcctcctcggacgaagctccacgcccatgcccgccaacttccccggcccctctgtttttgtgcaatggaccctccttcttccccttcctcctttgctccctccctccctccctccctccctcccacgagcccgtcggcagttggtcccgccgacctggaagcgccgggaggggaggagataagggctgcaccacttttgggcggggaagaggacgatctatccaaaggacttctctctttgggcaatctcttt

SEQ ID NO: 7793 - DNA, 700 bp, Nannochloropsis_gaditana
ccgctggcatcaactatttcccttctcgttactgatctggttgtgatgtcctgatcatgtaaaacttgcatcctaatcgaaaagtagcctttttagtgtcctctaagtggaaaacgtgaattcgtgaggttttgactgccctcacgcgtcgacaggaatgtctgggcccagctccttccccccctctcccccccccaatacttgagggagaaatatgcattgttcacgtttacatgtgagcaaatgctgctggtactgcaaactcaaaacattcagcgggatacgatgaactgcgtcatggtcctgaatcatcccccgttcccgtctacctcttccccttgctcatctcacatttcctccgttccatcccgccatctctgtcatgcccattgactcagtttatttgacacctttcgcggcgtcatcagtatggggaaacccactgctgtaaagctgcggagatggaggatgtgttagcttcggctgacgccggccacctggaccgcacacattcagcacctccttccacattcatcaccacttcaagctcccttcccatcaactgcccctttttcgaccggcatcaactccatccaatcgccaacaacgccagcatcagtgcaccctttgcgcactgacatagattctcgcaatcacacccatccgtcgtcatcgcctccttccttccgcatctggcatg

SEQ ID NO: 7794 - DNA, 700 bp, Nannochloropsis_gaditana
  misc_feature (458)..(492): n is a, c, g, or t
tccagatccacaacatgcgacaggaatttgtggacgcacgacaagcccgtcaaaggcagcgaacaacgacgggcactttcgtctaagcggcatgagccccgttccactggtcgtggtaaatggaggggagggaagggaaggaggaggtatagtacggaggtaaccgagagggaactcaaataaaacggtggagcgaaggtgtgaaggtgtgaaggtgtgtggtgtgaaggtgtgtgatggcaggagtgctgaagggagggcgggggtaaggggaaggcagctcggagggaatcgaaacggagttgttcaagttttgccggaaagctgcaaagaaaccacgcattcacgaggcagcgtgaaaattaatcgacgggatgaaaaatcaagtacagaaaaagggaactaatggccatccgagcaagattgcttcgtgccagcctgctaacttgcttcggagnnnnnnnnnnnnnnnnnnnnnnnnnnnnnnnnnnntccctccctccctccctccttcgttctcatcctcctttcttcccaccctgcacgtggttttgtcctgggactcatccctccggccccaccgtcccacgctccgccacctccgaggcgacggcatcaaccctgccaccgcatcacacccaccccatcctccttcccaatctccctccccggtcaggtcgacatctacgcatttgggatg

SEQ ID NO: 7795 - DNA, 700 bp, Nannochloropsis_gaditana
gccactggtccccagcgccgcgtagcgcccggatacgtcgcaagacaaggactgagcatctacaccgggcttcaaggtcccgagaggaacgtccagagtttggtggagtgtcgaatttgttttacgcagcgtgccagcggacgacgacatccaaagatatggcggaaccggctccctctgggacgcgggtgtgtgtacgtgcgcctacaaggatctctctgtatgtgctttcctgtgaggggggtcgggaggttgagatggtggacacggggctaggggggctgggtctctggcgacttaggggcccttcacatttcatctcagaccagagtcgagaggtgatacgaaccaaaagcagaaaggcctagggttctcgggggtgtgatcttcctccatgtcattgtggaaggtctgcgtgcccactgcatccggctcgccagccccgctgtttcctcttcaaacagcctcgggtggtattttgtttgtactacattcaactcctcatgaccagaacccttcatgcgcccaggaaatttgtcgaagagggaatttgtgattatcttttcgcgctgatttggtcccatcggcttcatcgctttgtttcgtgccggctccagggagtacaaccaactttggcgagacggggtctccccttgaacccttaaataggtttttgcccatgaatttattcgcaatcatg

SEQ ID NO: 7796 - DNA, 700 bp, Nannochloropsis_gaditana
attttggcaatactggtcagcagtattcatcatctctcgtcaatttgcttttgtcggggaggtaggacagaagaacgcgaaagattaaggtatggaaaaaaaaaaaaaccctgaacacatgggacagcgatatatttttcattagccgcttgttatttgatgccaaattcttataacatggacatggaaaatgtcaaagagctcggacagggtgcgtgaacgaacgtggttggaaaagtccgcattccaatagttgtggttccagcaaacaccccgtgggacatcagttacaaatattttgcatagtacatgcagaagccattctcgggacgccaaattccctttttcttgccatttttttgggtgtgtacgaaacgttaaaggaagggttcgaaaacgtggaacgaaggggcaagctcctctttgcttgacttgcaacaaaagcaagtataagagcctgtccgatggcgtagttgatcacgattcaagcacttccatgtgcataacagcttggtgcagctgggtggacgcgaggctgcgtggttttcaacctgttggatgtcttgatgcttcgctttttgcccgctcgctcaaagcatggaagacgaaatgcttcttcctcctttccttggcgttttcatgtacgcgagtttccctatattcaacaatttacagtttatatagccttttcgcagcaatg

SEQ ID NO: 7797 - DNA, 700 bp, Nannochloropsis_gaditana
ctgaattgatacctcatgacgtttcatggctcagatttcagttgttgtcgtcgcgtaggtctattttgtgagattatccttagtacggtcgtagtaatccgggagtcaggtggcaagtgtgcctagtaacggtttttcaaatttggattccatgtcggccacgcccgagcagggaatttttagggcagctgaaatgattgaaaaagatacctatagcttgtatatattgtttatattgaggtatagtgttcttaaatagtgatatgttgttcgatggattgagacttgatacggaaaacggcacaggcgttcgaagagctcttttcttccgggatgagtatcatcctttctgctattcctcatttccaggtgactgcagactattacttcctgtggtgtcctgtagatggggtcaaatttcgaagatggggtcgcattttccattctctcgtcatagacatttggatttcatattgctggagctgtgcgatgcggcgctaaaattttgcctgtcttttcatgcatggcgagctactttcagatggcgtagtgttcacatgcctttgcgtcgtgattcccgaactttattcctccgtggtcaccgctcgcaaaattcaagcttcctttaactaatgacattggtctctttctgttgcttcttcgcaatcaaacaggacacagcccttcacgctgcgacatg

SEQ ID NO: 7798 - DNA, 700 bp, Nannochloropsis_gaditana
  misc_feature (576)..(585): n is a, c, g, or t
tcccacgggcatcgacacgatgagcactgcgtgtcttacaccatttggctcgattgtcaacgccgagccacagacagaggagaggggcagtaggtcgcgctaggtgcttcgggtatgcgtgggatgcgagtgacttgccctcccaactttgtgggtggaatcctcgcatctgcctgacgctccagactggtaactctccgcgaaagccaagaaaaaaacaaagtgtgcaaaatcaccaatcgcttgctcaaaacgtcccggggggccccgaactgtgtcggctctctttctgtgcttcgaatcactgcctgctccaatccggtgccctgcgcaaaatctcccactgtctctggctctcttccatctcgaccgtgcgccagtcaaggctccaacccccctccgcctccccaccttgtcttcctcagtcttcttccaaaccctgtacccctctcaccactctgttccccgaggctggaaactgccgctgtgagaaagaaactaccggcggcccctcagaagcttcctaacggcttgcacgtgcaggtccctcccgtcccgccccttctaaccctcgcnnnnnnnnnnctccctccctcccagttacgcaacctccgcctgggctcagacccacctgtatccctacgtggatcccagccacttgcaatccgagtaccggagcctccttaccctcaaagagctg

SEQ ID NO: 7799 - DNA, 609 bp, Nannochloropsis_gaditana
gtgggagagggagggcgggaggaagtgcggtcggtaaaacaccgtcatgtcttcttttctgcttgacttcttccagatggcccttgatccccgggcgggcggcacctatatttacggttgatcgaaaagggcgtggcctgggtggatatccttgtatgggagtctgtgatcgaagtggggtcaggggtagatgcagtggggtcgaagggagataggcgggaggggtgcgcgtgccttggacggtcttaatgagacttaatttcgcggagaggagggagcgacgcgaaagacagagagaaggtttctattctgcacacatgggagcctacctcactcttcctctcatcttcattcctccgttcctctctccttccctcattccttccttccctcctttcttttctttcctccttgcagagcatttttgtgccatactttggctacatctggagcgacattcaagcagacttacgtcttttctccatcccgtcctcctcctctgtgccctccagcattcttgccgttcacaacggggaagtctccaaggagaagaagaaggagaaaaaacgtcggcgggaggaggagggagccaccggggaggacaggatg

SEQ ID NO: 7800 - DNA, 222 bp, Nannochloropsis_gaditana
ccccctctgtctcctaccctcccttacttttccctcccttcctcttccacgtatttcacttaagctgtgttacgactttcttgaataattggtgttgatgtattttgatactcatatgccaccgtgggtcttggttcctttcttccgcccccccagtattcgatccaaaacgtcactcgtctcggcgagctgggggcctgtcgtctcgtcgtgacggcaatg

SEQ ID NO: 7801 - DNA, 700 bp, Nannochloropsis_gaditana
gaaaaagtcttctgctgtagatgggacggacgtcaagagagggcggggttcatgtgaacacgccatcggacactctcggtcagtcgccgctcgctacgtgatggaagaagcagttatgagagatgtcaattgcactcatcgtttgttctttagccttccgaactcttctcctgagctcacccagcgtggtcattggctcacgttaatctccctcgcctccaagagcacactgctggctctgttttgagggaactaccttattttattacacaagcgcgacggcgtcttcgtccgctgaattcctttgtgcacctacgttcccttacagaagacttttggaacatcccatttcataaccatgtttaaaacaaaatacgacaccacaaccatcagaaatacgtggctttagaagtgaaaaggtcttcattgtctgtaaaattcatcccaaagccaccttatcgcgtgcgagcgtcagtccatcacgatgagcttagtgtcgacccatcaagatagcgaggacaaagggaaactctacaacaaccgcgttaatgctgctcgtgcggctgttatggctaatgctagaagagctagcaataatccggccgataagcctgcaagacttaccagggagagagccagtaaaggcagtcagcaaactctcgagattaaaaatcaagcctcaacattcattcgcaaaatg

SEQ ID NO: 7802 - DNA, 700 bp, Nannochloropsis_gaditana
  misc_feature (1)..(523): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggggactcaccgccagtgatctctttgaccatctcggagaagagcgtctccgtcaggtccatcaggtcgtggtagtccgcgtaggcctgaggggaaaggtggcgagggagggaaggagggagggaaggagggagggagaaatgtttcgtcagacccgttcgagtgggacatg

SEQ ID NO: 7803 - DNA, 700 bp, Nannochloropsis_gaditana
tggttagattccgaaaggggaaggcttaacgatgatatcgcctcgcgccgcgatatctggagagaaagaaggaagaacgcgttcttggcgtgtcaagtatatcagatgggccgctttatgaaatcttgtgcggtcaatcctgccttatagtcccaacatccacccgccatcgtgtccagtatactttcatgtgatacaggtagtccgctggtgaaatattttctcttccaggcatgatggtaccgtgggtcgaagaaggacgcaaaaagcgttcgacgggagtcaaatttcaaaaaatcgtttcgtcggcaagggagaaatttaaaaattgcgcgaaggcccccccgggaagagaaggtgtccgcttctcggggggggagggggcacggtgtatgtggactgttggtgtaataatggtggaatgacgatgccagggtaatatgtaggtggtgtaggtatgtgtaagtcttttctttgcctgttctggttcgcgcttttgtttaactgtggctggtgccggggcttcccgcattccccttggatgatacaggctcgcaatcagtctcttcctctcgtcacggatcctggacctgcatgctatctttccacgatctgccacaaatttgaaaaataaattagttcggaagctgccgctccattgtttgcgtccatctcgcgtgatttgtggccgtaaggaatg

SEQ ID NO: 7804 - DNA, 700 bp, Nannochloropsis_gaditana
tgtgtgagtgggcgcccgtagtctcaattctttcgcctcggaggaaagaaaaagcagacgagaaatggatcggttgggacctgccaagtggtgcggacgccaaagcatcttagttacatataaggaacaaaaaagaaaaggggctgataaaaaaagtggcaaagatgacgtacgggtgcggtgtcattttgcttttgcttgggggggcaggttttttatccgtacactttcgtctaaaaggctgcagagccttaaatgagacgatttgttattaaagaatagggcgcttgatccatatcatttcgaactccactgtccgatgcattgtcagggcaagtctttggaacatgaagggaagggggaggaggttattctggacgtattttgtcgaagcgaaacgctcttagagagtactcgtgatgtttgaaatactttgtggatgacaaatgtagggataatataatcccgctgcttatatgagacaaagacgggtatgtgtgaagcctgcagcttcccggtggacctgcggctgtaaactcaaggaggcactgattctccccttgaggcgccgtctgtcctgacccacttcgtacgcccatttactacccatcttactactactttacttacatctttcttctccattttctccttatgattctctcacagggcctgtgctctcccctttcgacctagcatg

SEQ ID NO: 7805 - DNA, 700 bp, Nannochloropsis_gaditana
agacgttgaaagcacatggtccaagtcttcaacatcactatctggtgctttttcctttttgccatttcaggacccgattctctctccttacactctctgtagaaaagcttgctcgtgaagtgaagcacgacatcgaattgtcagcgtactttgcgtggaaggtaaaaaacgaatattaagtctcacaaaaggccaatgtctaaattgagaagcctgctgagcgtctcagagggagatcggatacgacccaacaaaaaattgcacacccctgatacaaaaaatttcaagacggtgtgggcatcgaactaaaactaccgctcgcattccactgcatttgaacctaatctatcgtcgacgggtgataaaaaataataattcaagctgctcgctgcgtctcgccagaggcactagcgaggaggcggaataccgaaacaaccccatgacgctctctcatatcaattatgcttgaccgagttcgtgcacgggtaaccaaccattgtaggcttgaaagtctggttcctcgtcgtcgtggctggcggaggggatagattcttaacattttttagacgcagattgtcgctccctgcgccaaagccttactcgggcagcccgacgttccctcattattgctcacctccaaatccacgcccggcaattgattccaatcacaacagtggtcgaaaccttggcttaaaagatg

SEQ ID NO: 7806 - DNA, 700 bp, Nannochloropsis_gaditana
gggctatcctgatgtataccataagtgataatacagcactttgcgttgggtttttacgaacataactgaccatcgcatgaacggtctcaccactgaaaaggtgatgacgctgaacaaattgctcggccgttctttctgttgtacaaattttcaatggagtgcgtgcagatgtatatttgccgaagcgaacatcacaagctgttttgcgactggaagagacagaggtcgtcctacagatgaagtgggtgtaaagcaatagcaggcagaagacacttaacaacggcggtcgcgccattaaatgagtacacagcgttaagcagaacctgtcagaaattgtgcagggtaaacaagttctgaaaattggagatatgactcttcacataagccgggaggtagtgcgaaatatcaataagctcaggaaattactttgcataattgacatgtaactcccacaatatccagcgaatttcgatgtctaatcatatgaaaattattttagccctgtcaagtagttgccaagcagggcacgtgcttcttggttaagaaaatgcaagtttcgaccggaagcctactgcatcgggtaacggcttctgagccgttggatccttcgtctgatcacgaccacatccaaaatggatttcttcacgagttcatagctttatcgctccatatacccttcattcgcagaaaacagcgcatg

SEQ ID NO: 7807 - DNA, 700 bp, Nannochloropsis_gaditana
caaagcagatctgaggactcgaacaaagtcatgaagttcaaacgccagcaggccttgacacccacgccgcaatccccgttcactgacttccgccatcggggaaacgaggaggaggaggaggaggaggaggagatcgttacatttcgtattgacggacaacacgttccagcgagtaacacaacaagcacgccgggggaaaacgagctgcacaaattaaaggatgcagacgacatatcgcgcgcagagacgtaccagcgagtacctctgacatgcacacaggctccggcacagtcctcggtccctattcccaccaccgacgctgtcgcgttcgggggccatccctcttactcctgcgcgaaaaagcctcaagaaaaggccatgcacaatatggaagcggtcatggaggcaactgcagccaagagtgttggcgaaacgaatcctttgggcccagcgtctctcccctcaggtccctgcgccccctttgatggcagcgacatgaaagaccacgatggcttgagcctgcccaaggaaacggcaggcatcgacaaggacgtgaaggaggaccaggagatggacgagctgaatggtcgcttgtcggaaggactgtccctgaaatacgatttcggcggagaacattgccccaagtactctcagagagaagtggacttattggtgggcaaacgcgtggaggaagccaaga

SEQ ID NO: 7808 - DNA, 700 bp, Nannochloropsis_gaditana; identical to SEQ ID NO: 5156

SEQ ID NO: 7809 - DNA, 700 bp, Nannochloropsis_gaditana; identical to SEQ ID NO: 5158

SEQ ID NO: 7810 - DNA, 700 bp, Nannochloropsis_gaditana
  misc_feature (1)..(522): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgaataacgggggggggggagcagacgaggcagaggcggagggacggttcggcaacaccagtcttactcctggttttcagcgcatgttcacaaccgccactcctgcttcagccttggcgtatacaacgaccgtcacgcggaatcataccagcgagacaaaaggtgcagtggcgatg

SEQ ID NO: 7811 - DNA, 700 bp, Nannochloropsis_gaditana; identical to SEQ ID NO: 5162

SEQ ID NO: 7812 - DNA, 700 bp, Nannochloropsis_gaditana
  misc_feature (195)..(204): n is a, c, g, or t
  misc_feature (495)..(504): n is a, c, g, or t
accatcaattcctctccctgagatgaccctggcgaggcttcgggaccacgcacaccttcatctcctctccgtcaaaggcacgatatatgatgtctcgcctcaggcagaagtaaggacactgctgacgatggcatggaaatgctttgagattgtcctggcatatttctgtatgtttatctcttagtttcccctcannnnnnnnnncgtggaggaaggtgctgacggagggagggaggggaaggaggggagggaaggaggagcgaaggttgctgccgtcgagcgaggaagaagaggggggagatcgaatggagagggaggaaagagaggaggaggagggaagtgcatgtgtctgggcatcgtgggcaaaggaggacgcggaggcaggggaagagatggaggtaggtctcttggctgagaggagatagggacggcaggagggacgagaaagagagagaaggaggcggacgtcagatagatatactctctctctctctnnnnnnnnnntgtgtcaagcagagcgggtacaggcgggaggcagggaaaggggggaaagtgggagggagggagggagggagaaagaggcaatgcatgcatccgcgtcacaggtgaagtgacaatgaatccactttccgccacctgctgtcccttccttctctgagcccttccggcgtctccttcatctcgtctctccctcttggct

SEQ ID NO: 7813 - DNA, 700 bp, Nannochloropsis_gaditana
ctgatgaagcaaaaatcgacagcgaggagccgtgtcggcgtccgtaggggaaaggtgtaccattgctcgactagacggtcttttcagcgcggagacggggaggacaaaggcttctattccatccgaaataagcaaaagcaggagaaggaggagggtggcgacgcagtggaagcaggaagaggatgcgttggctgtgtgcgggtcaaagggggagagcatatgaggaacctcccagcccactccgagattaaaatgtgtccgcgacgtgcttacctcttctacggattcgcagacgcttccaagtgcatgcatcccagaggcttgaggactccatatgtgagcccgtactgtgcccggtggagatgtatctgttccgaaattgttcaacacttgctgaaaaaacgagggatcaatggcaaatacttccgcttcaatggaagacaagcggggaaggtgcaaggcctcacacctgccacaaaatcccctggcagtacacacattcgaattgatgccatttgtgatcagtcattctcctgcctacttgatgtcgtaccgcacttcgtagggagctgcgagggcttcgccgtctctgccatcgctggcgtcgctggaaaattaggggcttgggaacgcatttctgccgtccaataaatacactcccactgatagaccattcgttccatgccgcaggtcgacaatg

SEQ ID NO: 7814 - DNA, 700 bp, Nannochloropsis_gaditana
gttgcagcggccgggcttctgatggtcaatgcgttcttgaaaggtgtgcaaggaggcaagctcgacgaaagtccggtcctccgtgctgccgcagttcgccggctccgagtgacagtggagccccccattctcgtggtactgtgtggaggattgtgaaagtattgcgctgtgagaccgcgggcgagcgaccagcctcggggtcggcgaaagcctctcaacctgggcgacggccgggctgtctcccttctaccctgcctgcctccctcccaggactggactacggacatgcttaccgcgccccttcccgtatcacatcttctctatcattaggagccgggaggaaagattgccagaaccctacagctgagagggttgagggagggcagagacagcggcgcatagcacctcaagtccgaacaagactggcgaagtgaggtaaggagcaggatctctgccgtgcaaaatgttcgagaaaacaacatttttggccgaagggtatgcataaaaacactgagaggggaatgatcttgaattttctggttacgttttaatatcgtggagggttaatcatgtccctcgagaacctacagcagatgaccaaagataggctcccctaagaatatacacgcaatttattttatgggtttcacgtcttccaagctcccacagtgatcctcgtcaagtgatcaaaaggaggatg

SEQ ID NO: 7815 - DNA, 700 bp, Nannochloropsis_gaditana
agctcagatgagtgttatcctcgtcttccactattacgaggcggcccctcttcatgatggaaggcgcgatagaaggctactgcaaagctatcattttccctgtagacagcgaagggtaggacatagaaagataggacaggcacaaaataagaagaagggaggactttaccagtgtggtgcgattcgatatcagcacgtcacacaaccccacgtctctacgctcgaagaggaggctccttgaggggaacacgcccctcgtcgccgcccgcatcgatgcctcccacaaaacaccaccgaaaaggcggtcacaaagctgctcggggacgcccgcgttacgatttgagacgaggaaattgcgaagaggacgcactagccatccgcggggaaccacgcgtgtattttctgggctctgtgtcgtgaagagcccgtgcctttctcgtgccggtgctgtccgccggcggggttcttccgcacgacttggtgatgatggtgcctttatgcagcatatctccaaccattcccaaccaatgcgtcatcattaccaatactaattcctcggcttactcatactattgcaatgctatttctcgcgcagattgactgcatgatcatgcactgaggcgtgccgccaacgttgcgctgacgcttcttatccttctataccttggatgccagcactcctagaccgactcataccatg

SEQ ID NO: 7816 - DNA, 700 bp, Nannochloropsis_gaditana
accggtgtcgtcaaagtaccctttcgacagaaaaatgtctggtgttagaagccacaaacggcaacctctcggagaaaatgtactacacgcggtataagtcaaacccatcaacaggggacatacaaatagtgatggaggtcggaaaagcactcaagaaatgagttgtttcaacgcgtgcatgaaaacggattaaaatgtacaataattgaccttatcacgtccttctggactagaacttggtttgccaatgacgagggacattttgcaaacactagaatgcttttcctttcccatccctccggtcctgcgcccaatagctcgggatgctcgccaagaaaaacatctcctgtcgcgcattttttcccctccctttaaacgaacatgaaatctacgtttagacacgtaaaaggtagcgagcacactacctgggaataaaaagaaaaatgatcgcaccagccctccattgattgctctccaacaatgcggagtggagtccctggaccccgcaggaggttatcgtatgctcgacaaacggtcacagccccgggcttccaagcactgagggtgtacgttgccggaaaggcattacgtaacaagatcagtgatagagatgatagaggtgcatcgggtttcgaagagatgctgtcttttgattttgtagaggttttcgctcaaactgcccagctcttccatatacata

SEQ ID NO: 7817 - DNA, 700 bp, Nannochloropsis_gaditana
ggtaaatggtgaaagtatattccttgactgtgttcggcctgacgctacctaccaaagccaagcgcaaccaaccagtttgaagttatatactgtataaagcgtggaggaagggtcagttttgcattcatttccacatagatgctcctccgacttgaggtcaatcgatggaggagcctgctgaggaaggtggcttacgcagtaaggagaaataccaagtccaagagcaaaacactgcgtgatcgtgcacacggattcacgaatgccgcgcccaacggttagaaattgcgggaaaggtatgtcagccgtgacttgatatcagagtgcagacaatcagtgagaacaaaggcagaaaagcaacgggcatggcctgcggccagtgccaggggcccgatggagggctttgtgtggctcctgggagtcgggatcgagccactctgtttttcccttgcatgagtggacaaggctctcaatagtgtcatcgtctcgtgcaatggacagcgtgcaagtttgtggaatcttagcagaagtcatatgctggtcgcgtgttgttgacaaggggtgggggccttacagtccaccccacgatgaaaacgacactctgctttcgtatccggactccctcagttgtccctctatgcactcaagctccggaatttcacgacgcgtcgcatgtatataaacacacacagaaactaccatg

SEQ ID NO: 7818 - DNA, 700 bp, Nannochloropsis_gaditana
ctccagcgaaaatcgttcccgtccggctatcaactggaaaaattcctgtgcctgcattgttggtgctaaatcacctctttttagttataatcagccagcacgacgagaacatttcactaaatgtgccagctccactttaattgcccgagcaatatgcccatctgatgtatacttgctatctactctcttccttcactcgattgtctctggtcacatgagtcaggcaagagaaagatcaaacaatgcaaaaaagatcgtgagtgcataatgtttattttcaataccaaatttcgcttttttgctgaaagcgaaataaaacttcaaccagtcgctcagtattttacgttgaacgtttcccccggaaggcatgacgatatcccagcatcgtctcttttgttttgtctgggctttcccgtaggcgttattgggataaaaagatatgtgatcggtggctgctgacctcaactcatcattcgttcacaatttcgtcccattttcgcaggcgcctatgccatctccgcatgcgtcgcataagaatgctccgtccgtcactatttataacctacctgattacctgcctccagtcgacgaagaactccactctcgtatgatgaagcattacggtgaagagcattggaatcgtatgcgtcgggcactttctaccagtccatctcattcctgtcttcgtgtgaacactatg

SEQ ID NO: 7819 - DNA, 4 bp, Nannochloropsis_gaditana
gcct

SEQ ID NO: 7820 - DNA, 700 bp, Nannochloropsis_gaditana
aaagtcttcgcaacgtgtcaatgacgagaacgtcttgcggccgaactttgatggttgcatttcaaacatttggctggcactcggtcgattcggagaggtctcccggggaatcctacgtatccactgtcccatcacccagcggcaaggagaagattcgtgcgtaccaatatgcacgaatctgagccatgtgaccaccaagcatgtctttcgtgcacacggtcaccgtctttactgaaagcgctgtccttgtccggcgtgggatgcgcgtcctacgcaaattattggtgtcgttccgagctgctgtttgttgcggcggatgatcttaggccgccgggccccaggacacattatttggcgcccatggacggggaccgtacggttgtctgcgtgggacgtcgtgtgaaacacacagtgtaatcaagagtgtggatagagcgcgtagccttgccagcgtcgtcagcggctttgccgttttggtcgctgtgcttggcaagccttttactgccgccgccgaagcggatacctcgacgttccgtcttggcacacattaagcaccatttcttccctccattacgacaggacaacatagagcaacaacatcacctgcttttccttcctctgctggggcgtcgacagcattggaaggagaaagcacacagcttcaagttgtgtcgcctacgctgccacggctatggccatg

SEQ ID NO: 7821 - DNA, 675 bp, Nannochloropsis_gaditana
ttcggtggaggagcggggaaggaggcttgcacgcgcgggggggggggcgacgaggacgacgagcgaagcccacacgagccaaaaagcgtctctaagcgcgaaagatggggcatgatgtcgttttctctttctacaaatagttatattaatggttggcctcttataagtcatcggatttcaatattcctccgtgtcgagtcgcgagctcgcacaaccttggccgcagcgggctaaaaaaccttgatgggtgaggataacaaaatctttaataatttctaaatgttgaatgagctcgctgctagccgttacaattgtatatactcaccgtgaatgtgattgatagcgctttttcagccttgagaacgttcaccgatcagttgaggcctcgagcttcccccaaaaaatgcacgtatattaatgagatgcgtaaaaaaaaaatacgtagattcgtccatagcattacatatgatgtaataggaaatttccagcataaaaaaccatcctttacactccgtcgacaccccctagggcgggcaaatgaaacattctggggcagggggatgggcgagtactgggggaggaggttgagaagggtggatggcacgcgaggccgcgctcccgcttcgtcgtcccgggatacatgccgcgtttggtcaaataaaaaaggatcaaatg

SEQ ID NO: 7822 - DNA, 700 bp, Nannochloropsis_gaditana
gcatgacgggggtagaggccgtgaaggggcttttagaggctgttctttcctttttttctggctcaactgagatctcgaggggtgttgctgtaacttcctctgcaactcgggtgaacacgtcgcgttggacaccacatggtttcttgaccctctttgacttccctgcgttgctcaaccgacgggcacaattctattggcgtgccttctattgagcgtgatgggcaaggcgtgaccaatttttcgcccggatgcgttgccaactcgtgcgggctcgaggccgtcgacaaggcagaagcagcccccgccgtcgcgggattaaagggcaacaccaaaaatctttcctcattttcttctccggaggaggacctttccaagtcacaatggaatactttaactttcttttgcacataccgtacacacaggggtttcgcaactaccgcgaagattgacagaattccgcactccctgtgcgccccctcccccgaaggcccagcttcggcgggttgcctcgagcgtcgcaagccctgttgattttttttctctgtcggcagtttcgattgaaaaattagcagatcgattgagactctctggaaatatcgttgccttgctttgacacaggtgtggctcctgtagcgtgtggagtagtagccaggaaccaagacgatcgaagttgcagtgcgcctgtagccgggggaaaatg

SEQ ID NO: 7823 - DNA, 44 bp, Nannochloropsis_gaditana
agatgctttatggaggggaggggggagggaacgagctgcccatg

SEQ ID NO: 7824 - DNA, 700 bp, Nannochloropsis_gaditana
cattcagtccatctccagccagggacatgtcctatcacggggatggtgtgcgaaaaaaggggcacaatttagagcaagctcgaggaacaccccagcgtgatgggccggtcgtcacggctgtgctatttctagacagcttgcgtggagggttgaaaaacgcgaagcttctcaggcagtaaccgcaacgagcgaaagtcttgaggattcctcccgtcgatatcctgcaagactgtccaagccccgggcctttgtggggtggtcagtgtgctcgctttggtccctgtaaacaatccttttcgttacgcaaggggggctggcccagctggctgttggtgttgactccatttatccttgtaagtcgacggacggtaagcaaggatccctggaatgatcgcgaggtcaacttggatttctactcccacgctttttgcccaacggcactcttgctcacaatgaagcatgcgcatgcctgtgtgaagtattcagaccttctcccgcttgttatattgttgcacggtgtcctctgtatgaatatttgtaaggatggtaaatctagcgcatgttgagcagcgctcgctcttgccaccatcttaccctcgttcccctcctcttcgactttacacacgtcgtaccatctcacattctctcaacacaacatcttcctccaccagcttttttttttcctgcgcgttcaagaatg

SEQ ID NO: 7825 - DNA, 700 bp, Nannochloropsis_gaditana
ccaccgccagtacatggaaagggcccgacgtggcgaacaaggcgagggagtcgacctgccttgctccatcgcactccacaacaagccaagtcgctgctgtacctggacagaacggggccattgccactaccgaagacgcctccaagtctgacatacgacacctacaaagaccgccccaggatccccttaccgagcatattctcgacacaggaaacaaaggcacggcaggacaaggacaccgccggcgcacgtccgcgacgctctcatcctgggcttctttttcctcttcgaataccctttccttcttgacgggcgaggactcgtccatagtcgcccccgtccgggggcctgccaagctggatttctccacgcccgtccacccagccacgcaagccgttgatttcgtcatcaccttcctcctcgtacgtagtcggtccctgcggttgcttccgcccgtgtccattatcgtccacggcaacagcaccctgtgctcaaccgtccccttgtcatttatcccctccccccatccttctcggccccgcaggtgcattacatccaagtcttttactctctcgtcttcctctttatctacctggtccggcacggctaccgttggccccttgtcctggccggcctctacctcccttcctattttatccccttccaacgcctgggggggtggcccttccgccttctcatg

SEQ ID NO: 7826 - DNA, 700 bp, Nannochloropsis_gaditana
  misc_feature (1)..(663): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtggcgggggtggagggggtggccccgggggcatg

SEQ ID NO: 7827 - DNA, 700 bp, Nannochloropsis_gaditana
atcccttttcactcacgtgcgtcctgctcttcacacgtgtgtagaacggacacgacaacgaaatcaagcccgtaccaccatgggtgaatctgccacgccagtcaaagccgtccctgaggctgcttcgtcctccgcctccccacctccccccacctcagcacaaatacccccccgtccggcctctaagcccgtcggcgagctctaccgcattcgaccctggcacacagtgatcgttctcacgttggccttgctcttggacctgccttttttgatcgaccggttggccttgtccccctatacctcccataccactggcggggtcctggtaactggggcgtccacgggcatcggccgcgatgccgccatcaccctcgcaaccaaggagccaggactgatcgtatacgcaggcgtgcgaaactgtgagaaggaggagggggaatgagggggggtgacgagaaagatggaaggaagaagacttgggatgacgccatcattctcggaagcggtcctgccgcgggccttcctcaccagaccgctccctccctccctccttccctccctccttccctccctccctccctctctccttctcatccttgtcccttccttgtctcgccccatttcctccctcctttctgcagtgagagacgccaaagccattaccgccctccatttgccgaacctcctgcccgttaccatg

SEQ ID NO: 7828 - DNA, 700 bp, Nannochloropsis_gaditana
gcatgcgcaacaccagatactccaaaccgttgtacctgaccttcttcctgatgtttctgctgccgttggtgctcgcggcgacgacgaattcctgtcctagctttggttaaggcgctgtggagcctggctgtctcttccctggacgacttgaaggatgaaccaaaatgcggtgtattgtctacagccaactgtacgcccgtttgcttcaccaggtcgtaaagctcttgtttcaggcgcctcacttgctgctttagggcatggtgccgtgtggtgtacgcctgtcggtctttctgttctgtaaaacccgcggtctcaccgaccactgttcgcaaagtcggtgccatttaccgtatacagtacctggtcatgtatggaacgccaggaatgagcctccacaatgtgggtgtggcataaagggtagacggccaagggagtgtggagataatttcatatccgacgcatacgcgggaatgtaggcgaccctatggacaactcctcccgggagccgtcgagaggttttcaagcaaacggaaaaggatttcgtgtatattctttagctcgaacgtctcgaagcaccttttcgacagcggtttgtaacagtcggagtggtactcacacatgtttgtccattatttgtctcttaatacctcccccacaccctgttaggagagggtggctggcgcgagcaggccctcccatg

SEQ ID NO: 7829 - DNA, 700 bp, Nannochloropsis_gaditana
caagcgctcaaatgtgtgccatcaactcatgcaggcatagaaagtatgccaaatcccgcgcgcacgccacagaggcgggccccaaaccaggcgttttcactcgagccggaaaaggcagacgaaccgatcctcccccttcgcgtctccccgcccctcccccagcttgctcttttctcacgcccgccgtgcccatggggcacgtgcgccttctgcgctgagcgggcagtcctggatagactgggctttgaatatggttttcgctcggtcgcttgcagaagcatgctcgcatcacctaatttctttccccacccaccttcccgggcccccctagacgagaggggaagtaacagacgcaaggttcgagttagaacatccgcccaacgcttccaattcattcccttcagtcatcatgatggaagggcacgcccaaggagacgacgaattacaggtgattgacacacgaagtgaacagtgtctcatgttcaggctcgtgaggttgttgcggacatgatgggtttcctgggacctttttcacgtcctgacttccttcttcgtgaaatcgcgttattcttcgatttaaatacattcacgcccttacgacctcactccatcgtccctggattcctatctatagtttatcagggtccctgagacctcagtttcgaaccaagcctcaggacagaccccgtatgcccccatg

SEQ ID NO: 7830 - DNA, 700 bp, Nannochloropsis_gaditana
ggggccgcagggtcgcagggaggacatggagggggagggggaaggtgaagctaggtatgtacaagcgaggtattccgaaaagtccgccaccatttccaggggtggcggcagaaggatcacaagtttggccgcctcgtcgccgtccgtcaggaaagaccgtaaagacgggtggaagaagagcttcaccctccgcgtggcagggaggagacgtgcgaggaccgggtcctcactttcctgaggagagagcggctgtggaggaaggggctcaggctccgccctggggggggagcagggcggttctcgctctcttctcttcttggacagggcgcgtcccatttccctccctacaacgtgcggctaagtatgttaaatgaggaagaaccttttttttcccctttgtatctaacagccactctgatggtcagctgcccttcaaatcgtcgccgaggctcgaacttgccgggctgtcaggtggagtcgcgcgcacagagtacagcctctttacagctcaggtagctctataatacttttaaagatgctctcgaaaagatgaagctattgaaggtggttatcgggattgaaagggttgcttgcgacgagtcggccaacacacaatacagctccaacctcccctcccttccgcccgaaccactccaggaatccaaggggctttaaccctgccctgctttcgacggccatg

SEQ ID NO: 7831 - DNA, 700 bp, Nannochloropsis_gaditana
gaggcttggccgcttggctccggactaggtttcctccgcccttcacgacgtttaggtggcaagcgcatttatcagggtggtcgttcgggacgattagcgatggttgcgggtgcaagcacggatacagacgagtgggtcttcgacgtttgtttcacagggaccgggcagtcgagctcagtgccgttgcttaagcatgctgtgcgggggacgtgcaaggtgtgcgatgacgctttactaaaagcgggatccaaaaacaagtatgttgggtggggtatctagaaattgtgtaaagcggccgagtttaagacatgtataggtgcaagcagattaatgagacacctcctgtacggctgggtgtgccgcaatcccccctcaaatctatgactaattttaagcctccgtccacaggcggaacaatgtatcctgtgcaataataaaacgacgaaactccacgtcacgaggccaaacgccacgaataaccgccctcatcgactgcggtaaaaccttccgagaggttgccctaaacctctttcctcgctttgggctgcaagaaatcgggagtttacttctcacgcacggacatgcagatgccatcttgggcatggacgatttacgagacctgcaactgtacgagcacgtggacccgggcgtgaggtttccgtcagggccgatcaacgtctttctgcacgaagcgaccatg

SEQ ID NO: 7832 - DNA, 700 bp, Nannochloropsis_gaditana
  misc_feature (395)..(404): n is a, c, g, or t
acacatttcgcacgcatgcgtcatcaaatcctatgctcacagtgccctaacagcctttcccactccccctaccctgtctccgcccttattttgtacacgtggatcactcccggcgcccgaaactgctcgtcctgggcctccgccggcacctcctccaccaccagcccttcctgcctcatcgtcgccatcaacaacgcatctgtctgggcgctacggctctggtacgccatgaagcaaatcggaaagttccactctttgcggctttttggatttccctcccctgcttcctctcctccttttccaccttggcctttcccgctgccttcttcgccgctttcggctgtttcgttcccccctttcccgggtctttccagaccaggcacaaccatacctgnnnnnnnnnnctcccctcccttccctccctcccgccctccccccatgagtatcgtcgccaggtacctccccaagggcggcacgagctcatccaaccacactacatcggcagcgaccactacgtccaccccctccacgagagacgacgctggtggctgcaaccaatctccttcctccaccgccaccctcccctcctccctccctacccccggtgggccctgaaccaggcctcgccaagcccccacgttcctgcggacattgtcgttgagattctccagagcgtacggtaggtctgtcaagatgactt

SEQ ID NO: 7833 - DNA, 700 bp, Nannochloropsis_gaditana
  misc_feature (66)..(75): n is a, c, g, or t
cccggcgttgcggatcatggggggcgtgtatctaagcacctacatggctgcgaacggcacggaggnnnnnnnnnncctccctccctcccttcctccctccctgccaccctccctctctccctcccttttaccctctccacccacggaccatccgactgtccacggcctatccctcttctccccgaagcacgtcgcctccctcgttcgtacatcacccgtctcttccttcctccctctctccctcactccctccctccctccagcttccacacgccccaagtccttcgcaccctgggacgactgctggtggcccgggaagagacccgacaggagggggacgcggcctggtcgcgctacgttaaggaggtggacgagcgatgcggcgggaagatgcaggcggtggtggaggtgctggccaccctcgacgccctcttggccctggcgtcgatcgcgtcccgccctggctgggtccggcctacctacgtggaggcagaagacgaggacgcgggtaagaatgagggaaaaggcctccggatctccatccaagacgcccgccacccggtcctggatcacgtcttcacctcttcctccgccccgacctccctctcgtcctcctctggaccggcctccggcgtcgtgcccaacgacgtcgacctgggcgtgggcctggaatctccgggtagctgtttggtcgtgaccg

SEQ ID NO: 7834 - DNA, 700 bp, Nannochloropsis_gaditana
gagatgtggtatacatagtgcagtcattaagaaatagtaaagcatgccacaaaactcagctcgcaatttgcgaattgatatgggaaccacatttttacattggccaccgttcgtaagcaagggacgcagcagaggaaaagtaataccacaaaagaagagcgagtacattaactcacatttttacccaaaaaatctttgatatagtgaatgtttttataagggggaagccacctttacaaaccccccttagctgcgatttaacagtgtggaccgtttctggaagaattgaattttgaattcccgttaccatatttttctctcccaaggatctcgagatatccggggaccgtgcaagttcattacgctccattggctttctcatctcaaatatgtccaaccactatggctttgagcaatattttgacgcactacgcatgctgaaatcagatatgccggcatttttaaaacaattttgacgtttcgtgtgcatgtatggagtccctcgcgcaccctttctgagagcgaacgagacgctcatcacatcgcgtccctcgcccgtcggctccacgattcgagcaacgggcatagaaataagagccctggactgccttccttgacaccttttcttccttcattcctttaatcgattgatttcctcatatatatgtaggtccagtcaatctatcaccagcccggaatg

SEQ ID NO: 7835 - DNA, 700 bp, Nannochloropsis_gaditana
gctacttccctctccacaccttccatagagacgcccgacgtttcacttaataattttaatgttgttttgtccaaaaatgtcgcgaactctttgtcgagcacccgagcaggtcgaatttcaattgcagattgctcaattccccccgtcagcggattacctttcaagagatcttgaaaatatgcttccgcatcaatttcggcggctccctttatacgagcctgtgcagccgaaggatgtgtgagaaacaaggccgccgctagcttaccagcagtagcaccagagtcaatgactgtgcgtcgactactcaggccgttcgccagcattgttttccgagagagggaccgtaaagaatcgtcagatgtcatcatcagcttgtgatactgcagccgattaaaaacgtaagcagagatggcatcaggcatggtgaaaagcatcaccagtagaaggacgcgaacccgtcctcgggactgcatattttctggaggagaaggagcgtgcccttgcgtaaatttctcggcaatgattgtcaaacgtgcattgactgatgccttttagactgaacgggtctcgacctcgcgtctacaagcgattttgtcgttggcgaggccgcttgaccgttctgccccattttttgacacgctggaaaccctccttggaaacagagatgcgaccaacgcaaagctgtctatgcataacaatg

SEQ ID NO: 7836 - DNA, 700 bp, Nannochloropsis_gaditana
aagggaaatcccgacaagtcagggttggcctcatcggttttcgcggactgctggtcgaacaatttgttcactgctcgtgccatacgcctattcttggaatgcaaggagacaagagccaaaaattacatttatatatagattactatttcatgcacgatcaccaacaaagcccctcaaaacactctcccaaaggcgcaaaaagttttggaaacgaggcccctcgatccgttgccagcggcccctctaaccgagcggctcggggccgggaggttgccttaagtataggtatattggctcatcttgcacacaacttccacttcacacatcctttccagctgccccctcgtcgagtcctgtatgggaacaggaaggacaaggtgacagctgttctctttcctatattgctgtgtgctcttcccctgtcttattttggtattgctccaggtcactatcttcttggagcttgtcgcgtgcaaagtcttcgtgaagggaagatccagttttgatgtcaggtcggctcgctttgctggtctgcccattgcgaacaaatacaaatcctctttggcttgggattgtttaagcacaaatttgcagtctgtcactttgcattcattgttctcgcgtcattgacaggggttggtgacagtccatcacactgcaatcttcagcacaaaggtctggtcctcgagctacgacaatg

SEQ ID NO: 7837 - DNA, 700 bp, Nannochloropsis_gaditana
gttttggccttactttttctttttcttttctccttcttgcttccttttcctgcctgaaggcttgatggtatcttgagtgctctcgacacggattcgtcgccttatctcggctctcttaagtgaggcacccctctcgaaagaacagccagtcaaaatgaaagcaaaagcaatagccccgaaaaggaccttaacgaagagcagacagcttaggcgcagcttgaatctctcagaggtaaaaggatggtgtgccgggcacgaggcccaaccgggcactcacacgacgtgtgttttgggagggggggggatcgtgcatcaaaatgcagtcctcgctcgggacagaggagagagtatggggggggatatggcaaggaaggagcagagagatcgagataggaggaaggagggggaaacaacactctgtggcgtgaggtggcgctgtgcttaccttggcagcaaccggtcggacggatgggaagcggggtgatgcgtctcccaatccgcggcgtggcacgtacaactcatacctatctgatgtgcatcgcccgagacaacttctgctctcccatccctcccatagaaggtccttccttctttttccccccccctgcacctgcaaacacgttccagaaccgaatcgtctcgtccggcgccgccgataccaccgaggccccgtcgggcgactgggccagatggaggactc

SEQ ID NO: 7838 - DNA, 700 bp, Nannochloropsis_gaditana
taaaggaggcagccgagtgaaatcctgtcacactgcctgcccttggcgaccgcattgaggccttcaaacgaagaaagtgtcttggctatcttggagttttgttaggagttttggccttactttttctttttcttttctccttcttgcttccttttcctgcctgaaggcttgatggtatcttgagtgctctcgacacggattcgtcgccttatctcggctctcttaagtgaggcacccctctcgaaagaacagccagtcaaaatgaaagcaaaagcaatagccccgaaaaggaccttaacgaagagcagacagcttaggcgcagcttgaatctctcagaggtaaaaggatggtgtgccgggcacgaggcccaaccgggcactcacacgacgtgtgttttgggagggggggggatcgtgcatcaaaatgcagtcctcgctcgggacagaggagagagtatggggggggatatggcaaggaaggagcagagagatcgagataggaggaaggagggggaaacaacactctgtggcgtgaggtggcgctgtgcttaccttggcagcaaccggtcggacggatgggaagcggggtgatgcgtctcccaatccgcggcgtggcacgtacaactcatacctatctgatgtgcatcgcccgagacaacttctgctctcccatccctcccatagaaggtccttccttctt

SEQ ID NO: 7839 - DNA, 700 bp, Nannochloropsis_gaditana
aagccagtgaatgggttcgagcaggtttggcatatctgcgaggaacgttgcaaatatatttgcagctggaagagaaagggttaaatcgggtcatcccagggacagagcctgtgttcgatctgagcaaggtggaggagtccatagggcctctcgagtccttacacccagctcttcatggcgtgatgctcgacgttcgacgatatatcgatgatcgtcaggttttcgggggggtccacgcccatgggcaggtcttctcggacgaggagtaggtgcctaggggaggaacaatatgagaagagcttcaggttagcaatataaggcggaagtggatgagagtcgtccacaaagaataaaagcaatcactaacaagtgtattggaggtatatttgtattgaagatgtttaaatgctctcactactgtttcccgttcatgagaagtattttcccttttcgcccgtggacggatcgatttcttggaacggtctgtgggggcgcggccgtcgcggatgcgattgatcccaccctggacgacgagacttttggtcgcttttggaatctgcagcatctcggatgtcgaagaagccactcgggacctgacttaggcactttgatgcgtatgtagtgtgccgggttgagacaggatttccgggtctactcactccttctccctcctctcctctctcccccttagacaagcatg

SEQ ID NO: 7840 - DNA, 700 bp, Nannochloropsis_gaditana
cttcatgtttggcttggagcttcgaagcttcgggtggaaagccagccaggatatttctgacaaatctacgccacgtaccgcacccgaagcagtatcgtgcccttcctagcactgaattccatgctgcacatggtaaggccatatcccctaccatccacactgtaccagctagtcgtcactggatcttcaataataaggcccacaagttgctttttataggcacgctggcaatgggccgttcgatccgatgctaagccgctgcggcagcctgaggctcgccaacaatatggccccgcctctctttgttccgggcttgaaggggtacgctgtcaccgtgcatggaatgactatgccattgaggccacttatacatcgctttggatggtgtgacgattatggtaggtttcgtggaaacagccctggcattcgtgcaatgagctttacagattcactccaagccataactgccgccaaggcctgaaatgagctgtcatccaacctcaaaatatgtaatgcggtagcaacaatgccgtgctagaccattcttttagtagcgattgagtctgtgcatggatgagaatgacttcattgcctgattaagatccttttgcagtagcatacccccctaaaagtgctctgcaaacgcatctctatttcttcctttcaatccacctccagagcattttcacggcccaccatg

SEQ ID NO: 7841 - DNA, 700 bp, Nannochloropsis_gaditana
cctttggctctgcatggtcactttgaccgccgactcggctcaactttgcggcaaacaaaaacaaagcaacgacggaaaaatgaaccagcattgccaaactggttttattttcttgacaaaaatttatcgttcttcctcaagagtgatgagttgccagaacaatacctcctgcaggcaaaaatgcgtgtccacttgagaagacaaccagcttacctgcaagtgtgcaataaaaagaagcttgaggagggtaggctgtgtgcgcagtacccgcaggttcctctaccctttccagtccggtgctcgttgcttccatgcagcaggaaaaagaggcgagacctcatcgctgcagcctccctctctgaacgagtgtccaccttccgtgacgcgatggcctcctatccctcccagacccgccacctccaccgtctccaacaccctcgatttctttgcgtgccctacgttaccatttccgaattgaggggggttcaatggtgtcctcacgaggatgggcgagtcttggtggagatggagggggacgggaagcaaggctggcttcgggtgttggagtagccagcttgttgcccgcatgcaacaactaatggcattctgtgccaccatccaggtcggtcattcatcccaccacgtctcactttttgtccatgcatacgtctaccaaactctaagccaggcccgtgagatg

SEQ ID NO: 7842 - DNA, 700 bp, Nannochloropsis_gaditana
gtactgccgcgtattggtcattcaggcagatttgcagtacattcgcaggataacttatcttaaaagaatctttatttgatgctcctttttgttcgaaagagtaaaatgatatcctttcgctctgagcttcctgacagacagctacgtgacgtccgccaacagctaggagtgagagacgtggtaatgcagacgcgaaagaatctctctcgcacgacccttgatttacattgggcaacgtaaagattgtttccggactctcaacaccatctttgacggctagtataatgatactgtcattcgtcgaaatgtaagccaagaaattcccccacgtcgcgtaaagcatgggcctaccgtgaaaaagttaaaaatgtgttcgataatttgaaaccacaagaggttctcacagatacatcgttatccagattaaaaaaaaatgaaacatgactgtctcagtgtcctgctgtcaacgcagtgactcgacaaaaattgataactcaatttttgggaataagcgaggggcaggaggttctcttctaccgtgacggctcggagctgcttcgccgcaactcgctcaggaaaggctttactctggaacttgttgagctgtccgccaggctagcttcattgtcatgtaccctcaagttccgacatcacatgataatcaggcggcatacttgtgcgcgaatagctataaaaaatg

SEQ ID NO: 7843 - DNA, 700 bp, Nannochloropsis_gaditana
aggctattacggcttcgactaccggacgaattggtaccattttggcctgagaaaagactcctttcaaacagaataccatccacgggacccgtggtacgtgcgagaatggccagagggctgggtgaatattgatgagtaaaatctctgccgaaaagtagctggctagaggaaattgtcaggatattaagatgtttgcttgaatcgagaagaaacaaatgggaggaggttgggccttcggcagtcaccatgctgcactctcgttcttgtgcgtgatccgtgcttcctttttaataagcaacattttactttcaattattttcacgttaatcaatcctggtttgcaggctcacggccatgtaagctcaacgagtttcggagggaatgctttgtctaatgtggtaacggactgtcctcggcgcagtccctacggtcgtgtgcggcgataggatgcgtgacatccgatggagtccaaagccagacctttcctgcctttcagaccatccttgtccctgtttaaatttttgcgttagttggaccattgtgtggcaactcatttctctcacgaccctgcaacttttacagacgctttgtcttctctagagtcactcagatacgttgcgcgtatcatctccgatatcctctaatttgcctcttggagcgcttctattgaaacaactaccagctcctgtccacgaatatg

SEQ ID NO: 7844 - DNA, 700 bp, Nannochloropsis_gaditana
gacacaaaagcgataaagaacacgcactgcgcgcccgaggtggcacgacacagggagaaaatctgactcaaattcgatgtaaaaagcggcaggagtccatgtacacgcaggggtagttgatctgcgtgaggcctggtgcgtccgcggcaggtctttagggaagggctgcagcgacagcggcgtcgtcgcatcctcccagaagggaatgggcctttttaaaaatctgaacccccctaaacgctacaatttcggatcaatgtgccctattaactaccggcacattttcaaggcatgtcagagagagagagagagcgagagagcaagttttgcatactcaatcatttcgatttacaagcctgtcctgcacctctaaactctgcagttcttcttccccatctcacgcgtacatccactagacactatgatgcggcgccgatacgacggagagtctttagaggaaagctctgactatgttgatgcatctgggtctgactcggatgaggactcttcagtcttggggcatggtttgaaagagtctcaggcggaatggctgaactgcacgggtcgaaggccatgggtgttgttagttttcgttgcgagcgcaataggctttgtcatggtctctttttcccaagagacaacggtctcgtcaagatccttcactccctttgcggctttgcggggggtataccctcgaatg

SEQ ID NO: 7845 - DNA, 700 bp, Nannochloropsis_gaditana
  misc_feature (1)..(568): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgagccgtatcccaacactgaattaacatgagttaaatctctcagtgaattcttccgatttattttacctcgatcatttttgtcaatcagttgttccttcctcgttccggaaccattttgctcgctccatg

SEQ ID NO: 7846 - DNA, 700 bp, Nannochloropsis_gaditana
agttcttaattactttatttaagtgaagagaacacgttaattttttcgaattaatgctgactaataggcacaggttcgaggtcgatatgcagtttcgcttgaccgagcgcttgcccagatttcctggtcctgagtttaacatcacgccgacaacaaagtcaagattctagcaaaatggtttgagccttgcgcacaactcaatagtaacatttatcgatatcgtaatgccaaaaagcgtcgtataaggcgtttaaaaagcaaataggtatcttttcaatcatacgttacccgccgcatgctccagaggatgatgcagtcttggcgagactgcggccaccgctcgagacttcttccgcttttggctcggccaagctgaagcattcgatcacgcgagccgcgatcacgtatcttacacttttttttttggcggtagaaagggggtaatgctcatactctgggcaaagtggtcagatttccgcacctgtagttgttctctcgagctgcgtgcgtggcgagtttcgacctgcctctcgcacgaagcaagcctcattccttttttctcgtcttgtaagcgacgtacatcgagccttgttttatctctccgccaaaagtaacttggtgactgacggctatccttatcaacaggtaggagaacgttgcgtcggccgacttctgggtgtttcatcacattcgcacaatg

SEQ ID NO: 7847 - DNA, 62 bp, Nannochloropsis_gaditana
gggggggggcgcctttgtacagggacgggcggatggtggtctaccgcaatgaggagggcatg

SEQ ID NO: 7848 - DNA, 700 bp, Nannochloropsis_gaditana
acctcatcacactacaggcttagacgggcatacaccacaatttaacgtggtttttatcgttgccgggcatccaggtgggtcgccacgcctttttgggctggactcgacctccccgggcttaaaaacggtaaaattcaaactctttgtcagccgttggtccaagcctgcgcggccttcaaatggacgacataaaggaaaccagaagccaccggtcttggtgcggagcgcgcaagttttttttcgttgggtcgttggactgtacttcactgtcttcaggggcatgcatttatctcggaggggcttgcaaacaacgctgacctctttaattgcagagatgggagatggtgcgtgctcattttatttcgaacgtcctcgacaagccgagtcttgttccttccaaagcccagcgagacgtcacgtgccgcccaccgtttttacccgcaattggtaatctcgcaaaatcttttattctcgattaacacaacaattacacatttcagctaaaaattttcgttttcacccgatttacgcaagtcatgaagtgtccctacctcgcaacaattttcctctttccctttttcgtatcctcctccatcgaggaagtatatgaccggtaaaccgcctacattaatctttttcctctcttttccattcaatagcaggccagccagaaggaggtagacacgcaattctttagatg

SEQ ID NO: 7849 - DNA, 700 bp, Nannochloropsis_gaditana
cctgtggcaaacgcccttgtcggggtgatggaggccggggcgaaggaggtaggcctggtccaaggggagaggatagacctgcgggaaaaagcacggcgggtgccagacaacatgtatggtggcagagtgtgatacctttcctttttcgtgtgttgtgcataggtggagcggtaaaggacggtaacgtgtgataggtgagtatcttgaaaatgacgggcggcgggacaacacaaaatttgcgggagtacattcagaattacacatcacgaaggtgatttgcattttttttaaattacaagaatacatcaagcaaaggagctacggactcatgaaactagtatcgcaggacttgcgtagacttcattctttttaattataaatcgccaccccccgctttgtacccagccgcctccgcttggagatactccgacgcggagcatactgaaaaataagcctttggggggtatccgtgttgccgatgatgcgcgtccaaaatgtttcttgcatcccccgtgtataagtttcaaatgttttaaaggctgagtttcttcgaccattaatttccagaggttgagacaccggtattcgattgcatgcaataaccctgtacagtctctgcttggtagcactgatcgattctccttccccatagatcacctgagaaaagaaagtgcagccgagcaagcattgatttgagtta

SEQ ID NO: 7850 - DNA, 700 bp, Nannochloropsis_gaditana
  misc_feature (1)..(420): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggagggagggagaaagggagggagggagggagggaggaagggttagagagagggtggtaaaagtatgttggctacgactgcatgacttaatgtttatctgtcgttcaagctttgtatccctcccgatacaatatctcatccatgcgattctctccactcaatctccgtcctaccccccctcgctacctcacctaccctcgttcaggaggtcctcatcctcgattctttgcgcatcgccctccacgaccacttgggcgggcccgcggtctacgaaatg

SEQ ID NO: 7851 - DNA, 700 bp, Nannochloropsis_gaditana; identical to SEQ ID NO: 6629

SEQ ID NO: 7852 - DNA, 700 bp, Nannochloropsis_gaditana
agcggccgtttattgcaaggctcttgattccagatggaggaacgcttcaacggcctcagcgcgggacgaatcagggcgtgcagggatacggttgaacggtcgataggttcaaattgtacacgaagtatgggccatgcctttggtgcctcctttgcacaatatatgcggcgcaaacgcaaagggattgcatctggaataagagacgaagtacgccagaaaaaaagaagcgaccgttgagctacctgagagaaaagctaaatttgaaactcccacaggctaacggcaaggagccagccaggcggtacgagaaacaccacgaaggtcctcgagccctcccggtacgcgaaacaccacgagcatcctcgagcttccccaggcagatggacacaggagtcgggttgcagcagtgcctcgctccatgctggggaactgcgtcttgtcgtttcattgtctgctgaggtcaatttcagagtctttgactgtttattgattaatgtggagggaatttgcgtgtcatagacaggaaaaccttttcgcttctatttctgttggccttcgcttgttccttcttcaacaagtcctctgttggaactcgtggacgtctccgtcctctgcccccaatagacgcgtgaactcgtgctttctgacctcaccattctgttttctgccctcttctgtcgttttaaaacagaatatcatg

SEQ ID NO: 7853 - DNA, 700 bp, Nannochloropsis_gaditana
aaggatcggagatgaggacttggtaagggccttggatgtcgcgaatgccaaacggggcatcgaggaggtcacggaggaccacgagcaaaaacttacttgagagatgacattgccgggaagatgaaagcttactcgaatgtgtcctgtcaaggcgttcaagccgatgagtaaggtgatcgctttaaatactgaagccgggctcctaatccctgaaaagcgcgtgacccaagtgcggtctgcccctcgcccccgccttacaggcagcgatacagccgcttggacgcaatgaaagacgctcgccaagttttccacgcttttgttgacgtctccacactcttattttccttgtatagaatgcaatcaaagctaaagcttggacaggaagactggtgacacttatgtcacagtcccgacgggcctcctgcctgagtgtcgcccggacagacacgacgttttcgatacgccttctgacccctgcagctttttcctcaactcttcgagtcgttaaggagagtctcgacttgaaatgacaaagtaccccgatagagagtggcgattctctcaagaagactggctcaaggccagtaggttgaccgcgggtggagttaccttccttctcactctctccgcctcgcagttcttgcaagggcggcttctgggcatttcagctgcttctcgagccgctacccttgcgggcatg

SEQ ID NO: 7854 - DNA, 700 bp, Nannochloropsis_gaditana
ctctggacccgttcacggaccttgatgtcacctggtcagaccccgggaaaggcggggagtgggtgacacgcgccaacatccccctcaaggagcccaggacggccacgctttccttcaagcgcaagttcacattccaataaagtgaccctaaggtgacatcagaagagggaatgggttccacggaaatcgcatggagtgatgttggggatgtggtgctctaattaaatagcgagtttcatcgtgccatgcacaagggaaaactaacaaagggcttacaacttaatagggaattgagaagatctcagccatgtgttcttcaagataggctcgcgtccttctcgaagggcgctggccttcttggcgtggctggaggaaaagtgggttaggacgagcagaggtgcttgacagccaaaaacaaagagactgcgtaaagccagccagagaactttaacaagtgttgcagaatggagcacgaaagagatagatggaaaaaaagatgaccaatccagcaatgttttcctttttgcccttgcactttttgcttgtttgggggataagggctaggaggttcaactggatgaggcgtgctgagtaaatgctgccttctcttacatatttgctacctgccgccaaagtgggggttatttttatctgaacgttcatactaaatagcttagtagcaatcttgccctatcgtatg

SEQ ID NO: 7855 - DNA, 700 bp, Nannochloropsis_gaditana
  misc_feature (656)..(665): n is a, c, g, or t
gccaaggcgggcttggcctggagccccgaggatgtggacccggggcaggcgagggtcctagcctcggctttggcggcattgcgcgacagggacgggcgcttggaggcagacgataagcagggtgatggcgtcgggaaggggaaggcgaaggcggaggagagcgggctaagaggggaggccatggagctggggtggatggtgttgcgggcgacggggaacgtggtcagggcggtggagaccgctgtggacgcgaataggcgcatggcatggagccaggaagaagaggcgctgttcgtggagggcatgaacgagtacgacaaaaattttgtccagatcaaggtgggaagggggggaaagcgaccgcgggtgtccgctactcgggcggcgagcatgagtacgcgggggaggaggtgcaagtgcctccgcccaagctcatcctttccatcccttctccctctctccctcccttcctcaggcccttcttccgaagcgcagcgtccaggacgtggtggcgcacttctacgagtggaagcagcgggcggactaccgggcttggaaagcagaccggcccctccagtacctggagcacgccattcctgactaccacgcggacgtctgcgatgtacgaatggatccctcctgcctgacccccagcnnnnnnnnnngcggcttccaagacccggccaagggggtggacatg

SEQ ID NO: 7856 - DNA, 700 bp, Nannochloropsis_gaditana
  misc_feature (1)..(639): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgggggaggaggagaggggtgggggcaggggttcttcaactggtgtcgtggatggaatg

SEQ ID NO: 7857 - DNA, 700 bp, Nannochloropsis_gaditana
  misc_feature (390)..(399): n is a, c, g, or t
tgcacgagtcatcagcacagcgccgccattttgatgtgagaaagtaatggtgctttctgcgtgtcataaaatattcgttagggctgcttctgaagcggagacgtggctcacggcgaaacttggatatccttgacatcgcactattgcaatcgaatttacgatctccctcagtggaagaaggaaccaaagtatagactacatcaaatcagattgcagtcgcctaggaggtgatcgttgagggcgaaaaactttgatagccacagcgactcggctgctgagccatctgcttcggcgcccagtcattctcgctctatgcagcgagatacacggggagaaggaaaacgtggccgagggaataaatccaattctaacccgtatcgaaaagttgcnnnnnnnnnnttttgtcgcgaggagaacatccatgtggtggctaattcgccgcccggcaagatgagggacggatatccagatgactactcgctgctcgatgatcctgtcttgctccgcatcgccgaggaaagtggccgctcggcgtcgcaggtgctcctccgctggggcatccagcgcggcaggagcatcactcgcaagacgctgtcccagtctctcatggacgaaaacaaggacgtgctcgactggtgcctctcacgggaccacatgtcgcgcctggacgcccttggcaagggttggcgcttgacatctt

SEQ ID NO: 7858 - DNA, 116 bp, Nannochloropsis_gaditana
cgtccttctacgtggggtccaagctgtcgtgctgcgacgccgcgcccgaggacgtgaccgaagcgtgcaagagatcgattaccgagcttggcgtgtcttacctagacaactacatg

SEQ ID NO: 7859 - DNA, 700 bp, Nannochloropsis_gaditana
tttgcaaggatcttatcgcaatcttgtttttgacctttgagtatccataaaaaattccgatacgtgaagcctccctccggtacctcctttcctctatcttcagtcctgaagcgataccaaggaaaggaaagttgtacaattaaattgatgtcttctgtctggaaagaatcgtacagtcatacgctagcggcaccactaagacataagaaaatggccacaatcgagtttcaagggaccttagaagaatcttcaagttaaataatcccggagaccggctgtagatgcaaagtcgaagaggattccaaaaaaaccctattcgacgatcagcaccgccttgaaaaaatcctgacatgtccggcaagtgttcctggtcactcttttttcacgggcagtacgattgagagggaagcacgaatactgaaagcggtgcacgcagcggagatttatccagtatgaagtcatctgactggatacagcccgtgctagtgcatagaaccttttatgagaaatataaatgcgtgtacctacaatcgcgcccaatggtatacagatcggccaaagtgatgcatccttaaagacaacgtgatagacttatgtgtcttagacaacgtgcgtgactaatgcgtgcatttccctttacctcacaacaaaaagggcaacggaagaatcgtcgcctcccggcccttttccgagtaccatg

SEQ ID NO: 7860 - DNA, 700 bp, Nannochloropsis_gaditana
ctaaggctgtttttcacttgcacaacgaggaggattaaacgagatctgaccaccagacctttttcctttgcctagcggcgtgtccagcagcgggatgtgcggagatttttttcagttatcatcgtcctcgatggtgcgcgacctgcgaaaacctcctctatccttgtcttcttggcaagcagccccctcttatgtactatgtcccttccacgcgacagaacctgtttccaggaactcagaaagtgcagttcaggtagctagacaaggaacgttctgactataatgcttttcgtcgtatctggacattttcctcgcggtcatgcatgagtcaaagagggcctcgcgaaagagagcgctgaacacacccttcattaaaaccatgcaagattagggtgcacgattgaaccgggaatccctaatacgatttgtcgaagacgtgcatgagatgtgaagaaagcgtggtgtcactttaccctcaggaggtcactctgcccatttcccttcggcagtacatctctctgccacgtttcgcttttacgcggtcatttgcctcaggtgtgctctcaaaaatagtggaaatataagactagtagatctatgctcattttactcctggttttcgggtccacgtttaggtttttcgactgggaggagaaaaaacgtctcttcactaccattccggcccactgcttgggaaatg

SEQ ID NO: 7861 - DNA, 700 bp, Nannochloropsis_gaditana
acccttcgtatttgcacgcgatttccggtgggccaggcggggaggatgtctgcggcgagtcatgggagcaggactgcgagcgttgtaatccgtcgaggtcaaaagccgtggaggaggcttttttcagcttttccgctgcttccttggccttcgacaggaaatccatgggcacctacatgagaaacgtgcaacgaatcgagccataagattaatttgtgggaggaagggcaggacccctccaacgacgagaggagcggcccgaccggaacaatgacaaggagtcaaaagattaaaggtaaagggcgtgaacgagggtgcatcatgcaacctgcacacgctgcatgacattttcatgatgcacaaaggtcctagttagggtctcagggaggaatagacgcctaaatggaacgaatcgcttgctttatcacattgactgcatcctcgctcagcgagctgggcgatgacctacccaatacatatttaagaggaaacaaacgtgcccgagaagtacactgggctgaagccgtccacgaatggagacttgttgaatgtaaaatgcccagactggtgcttggtaccaatcaattaggtctttggcaggagtcaggattgcgagtgcagtcacaggcagcctccccctcctccctcccttctccaatcagcgtgcagttagaagaccttcaggacagagcaagccatg

SEQ ID NO: 7862 - DNA, 700 bp, Nannochloropsis_gaditana
ggtggagcactcctgattggtgaccccatggcgagccatggagtttaaaaagtgataatagtgacaccaattctttgaaccggttcccttaaatctgctttgtgacgctgagtgtccaaaaatttgaaactcgccgtgtgaagtcaagcgaagtggctgccctaatcattccatcgaggacactgtaaagtttcttcgcaagacgagctctgcaattcattgaaattgatagcaggccaaaacaaagcagagactgttcgtagtacgcttggtcattcatcataacattatttgaccagcacggaaactcctgtagagctcagcggcctctgcgccttcctttctctcgtcctgccccgtcctgtttgttatcgtatccagcagtacatggacgctttctaagggttgacaatatggttgtgcatgcattgttctgaagttcgagaatcatttcggtttttctatacctgccttgagaattcgaccggacttcccgtgagccgtataacgtgatgttcggcgcggaggaccctttggttccctcctttttttacagtccacccattattgcgggggttcactcgctgtgcaacacttttaacatcctggcgcacgtttcagatttctgtctccacccgtctcgtcgaaccagcggttgggcctgactgtcccctttcttttctttcccccccgtgagcag

SEQ ID NO: 7863 - DNA, 700 bp, Nannochloropsis_gaditana
catgtccatccggagtgcgtgcagggcctgaccataaagcagcagggaggaaagcagcggccaccgcatcctcgtcgtcgagaaggccagagccttccgcgcgtcttccttgcccctcccttgggcctccgttgcccgccccgtcaaccacgccgtcggtggaggaaaaaattcgtcttcagattgccgcgcttcagaccaaggctttgttgaaacagcagcgacgaaacagacaggacggacggccagatatggcaaaataaaaggtgtaccagcgcggcacgcattggaggggagggcgcgagtcctcaggtagcgatgttccccagcgtataaatttcaatatacattggcagtgtgtgtgagaatatcgtgagcgtagtcgtcatgtgcacacaactttgttcaaaagaagggaaatgccaaagtagatataagaggagaaagagggtcgcaattcaggatctaaggaaaaagggggaggaggttatagtctaacaacaaattacatgcttcattttgaggcaagaaatcaggaaattaaaaaagagaatcaacagcaaattgagaatcaccaaagatgtttgccatcgttgtggtacttatccgcaggtagttgcaggcgcggtatcgtacgacccccttaaccgctccctctcccctttcccgaccacttccagactcatgctcgacgaggatg

SEQ ID NO: 7864 - DNA, 700 bp, Nannochloropsis_gaditana
ttaatttctatcgtaaagcagcattgaaccgagtttgcacggggttcttgtaaacagcacctgtgagcgtgcgttgggcttacaagtagtagcaggaaacgttaatgaccgaatgtccattgcaattaaaataacgaattttcatatatttgaaaaaataaactcgaccacttagaaggtttcaacactatctgacgccgaaaggctccgtctcgattcataagaagtggaagtgggataattataccgtgtggcccatgccgggaggttggtgagcttgagcaacgacgcatttccacttcatcgcttaactcacagacgcatccacatacatgatgataacacaacagaacgacattccgcctatgtctattgttgaacgggacgcctcgcttcggccaccgtcatgaagagcaccccttggatacctccatcgtcgtcagtgccgggacggcctcgtcctcgagtttacctccttatctcctgtctcctcctcttatctattctcgaggtttacactttccttacaactcaagtgctacgtgaaagctctgtcacgatcagtcacaacaaattccgccttcaatcccggatttcggcgcttccacctaagcaaatcgttgtcatcggcgctggcatcggtggacttgtcacggccggacgcttggctcgtgcgacccgtggtcgtaatgtctcaatc

SEQ ID NO: 7865 - DNA, 700 bp, Nannochloropsis_gaditana
cctgtgtgttgcttccatgatccttctttcaggtctggcgagaggctaagctcccaatgcgcatcgacgggggagaagcaacacgatgaggtacaccctccgtaaagaagaaatttcgtgccgttggcaaacgcccccgttatggcagacatggtggggggaggacgaaggtctccttgaggtactgagaccggccaccatgtaggaagagatgacgccgaacggtaaaggagaaaagcgaggagagggacattccgcatccctgtggaaggtgcaagaaaattgtgctgtacgcacgacgtaagatgtcgttagcatcctgaaaggtttcaattatttcaatgagacgtatacaccaggaacacatgcttagggactgacgacgtcggtttagcgacgtctcctgtcctactcggaaattaaggttttttgggtcctaaaacttttctttacttagttgactgatgcagtgcagatgacaagagagccacgctgtagacggcctactcatcgatcaaattctgcacgatcaaatttctgtaccatggatcatgttcgaatggttttgactcatcccaaaagcttcttgaagaagcgcgtccctactccgcaaaccaatgctgcctcaatttcaacgaatctaactcactaaatgaatgcccacaggacctgctgcgttctattcattacaattacaatg

SEQ ID NO: 7866 - DNA, 700 bp, Nannochloropsis_gaditana; identical to SEQ ID NO: 5365

SEQ ID NO: 7867 - DNA, 700 bp, Nannochloropsis_gaditana
cattactcagacgtcaagaaatggagagggcaatagaagcggcaaaattggccgctgctcttgaagaggaaagggagcgccgacagcgaaaacgaggagagttacacggacggccattccgataagctgaattgaatagagaaatgttttaattttctgtatccatgtaaaagtaaaaattaaggtagcggaacaagctcgccagtgatactcaccgatacgcgggagaatgcgatcggacggctttcaatgtgccttgaagcaaacatagttgcaccgtgcctccaacgattcttgattgacttttttttctttctgcgctgtgctttaccgattgccatcgtcgaatcggtttgcgtcttgatctcatcaattggttcatgtatcttcaaccgagcaacctcccaccatcctttttttcccctctcccacacagctctcgtacccgctccaattgcttatctgctgcgttgccaaagtcatgtgccatggctgtaaatgtctcattggaccctctatgttggccagtgacctgtcatgcatggctgacgaggcaaaaaaggtgatagcgggcggggcggactacttgcacttggacgtgatggatggccacttcgtaccgaacataacctggggcccccctgtcatcaagcacttgcgaaaacactgttcagacatattctttgactgccatatgatg

SEQ ID NO: 7868 - DNA, 700 bp, Nannochloropsis_gaditana
ctttaaaagatgcccaagtaaagtgcaaagcggaaacgcaaacaaacctttcatggtggccatgcctacgttcgcaagggaagaactgctccctttgaacccgcttccgtacttcgataagcccgcaaatctcttctgtgcagtggggtagcagtcacaatggacgtgagcgatgaagccgagagaaaagcgcgggggcacgggtgaagagaaagagcgtctgattgcacggtgtggtcgtgttcgccacagtggtggtggagcttgtcgtggaaagtcctattctatcagcattggcaagtctatggactgcatcaatggcgaggcccttcatgaacactctgtatggaagccttcgcgcgtataagtggtcatatcttatttggaagcgacgttcttttcacaccctgtgagtctggttttacgtgcactcttcttctcgcgccatgcccgacggcgacagaggtcccggtgggtcgtaagggaagatactacctgatcgttgacattaaaaacacacacgtagttgcatacagttggggtaaatggagcgagaatgatagtataagtgttggcagatcagttttgtctattccgaaggcaatggggaagagagtcaggttttacggcccgtctaagtgcaacttttgccttccacccccggccatgttcaatgccagaccccaccacctactccaca

SEQ ID NO: 7869 - DNA, 700 bp, Nannochloropsis_gaditana
tactccgcttccagtgcatggatctcctccacaatttggccgtaggagactttggtgtaggcagagagcgcacgagggagggggagggaggcaggggcagaggggccagtgggctccgacgacgtgtaccccagggcctctggtagtgtggtggagaataggggaagtgttgggatgtgccgaggctcgcacgtgcaaggtatctagcacctgaggggaggcgctttggaataccgaggagcaagtcgagagagtttccaaatagcttgccctgaggaagccacagagttcacccttttcgaccctcccaccaaaatcctctctcctactccacattacacgatgctttgcgtattgttgccttacccagtaactcttcctcttgcaagaagaagggagggttgaggcgcgcgagaggggacctcgcccaggttgtaagcggcagaatagacagaagagcccccgccagccatactgaaagagatcttcccatctccaccctgtgttacgtgaggatgtgtgcggtatcggacgcggatgggcgcaatgggtgcatgtccggtttttccaagcggttgaaaaggacatgggcataggcgaagccagagggcgcatgcagctgaaaaaaacaggcagaacgacgacagattttgccctaaatacagcagccccaatgcctgcgcctcctgttcagtatctt

SEQ ID NO: 7870 - DNA, 700 bp, Nannochloropsis_gaditana
ggaagaatcatgatgaatgcacagagaaccgatagcaagaaatgatgcacgggcgcatttagatactccttcactatcttaagccatgtcaaccaggtgacaaggctggcagcttgttattttttggagaacaaacaggatcgagatcgagcgatacaagcaagaggtgccataccctccctgcttgctgcgagcaaaagtgcgggcgtgagagagacgcatccaaaaaaacacacccgacgacgacgatgacaaggacatgcccacatcccttgtggacgcacatccttcccacgcgcttccataaccgaagtacgggcatggagcctcgtactgcggtccaccctcacccaccgaagggtccttttccatcatattcatatgggccggggggggcctggcaactcgcaaatataaagtgcttcgtgtcgcgcttagaaccgagaaggggtccagggtgggaaatggaatgcacttacggtgacttaacagctgtttgtaagggaaaaggaatgtctttttgtgacaatcaacgaaggattcttttccattaacccgtaatatgggccaccaagaatagaccagcaacgaaacatgtcccaggcatgtccagtatgcgcactacatgtgctatcaaaggtaatcattaagaaatagtcattccctctgtatgtgttcccttttccccgcgcaaagcaaa

SEQ ID NO: 7871 - DNA, 700 bp, Nannochloropsis_gaditana
  misc_feature (1)..(674): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcctctccttcttctctacaatg

SEQ ID NO: 7872 - DNA, 700 bp, Nannochloropsis_gaditana
ttgtgacggcctgggcggcccgtggagatcactttcgctcctccgaccccccctacccatactaccgccacgcacgcaggcgttcctgttaccttcgcactggtcacatgcacccaacccacgtcaccatccacggcttaggttccctttctcacatgtgactacggcacaggttctttttccaggcataatgtgtccgggacctcaagatgggaagggcactggcctggtagagaatcccttggtggcagcagctgcgggcttgtatgcggaaaccgagcagccagacaaggacgaaggagtatgggattttttccgttcgtacactgacgagccccataagtcacggtaagagggtaggactgctgttagtaggaacacgattgacgagtaagcaagcagtggcggcccccgatagacatcacccggggcgggcacctcgatgaatgcaacccgggtttaggatatttcgtactatcctagcccatgaccatagcatccatctcacgtccccccctcatttccgcgcgttggttttcttgtccaggcgtgaggccatcttgaaagcccatcctgagatccggaagctcttcgggcattgtccgtggacaaagtacaaggcggccgcgatcatttccacgcaggtaatgcggcgggcgggtacggtatggagcctctagtgtggagcaggggaaaaatg

SEQ ID NO: 7873 - DNA, 700 bp, Nannochloropsis_gaditana
  misc_feature (1)..(628): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctccctcccgtcctccaggcaaactcttccgcggaggacctctcaagctcctctttgttttcctcatg

SEQ ID NO: 7874 - DNA, 700 bp, Nannochloropsis_gaditana
  misc_feature (1)..(688): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccgcaagctg

SEQ ID NO: 7875 - DNA, 700 bp, Nannochloropsis_gaditana
gacgcattgtggcggcgtctaagcatttcggaatccagcacatgcagctctgcttttcaccgtcccgacgactctgcacgtctgcggatgagcggcatttcagcggacgtctcatttcgggcacaattcggtgcgtctgcatgttatcgcaccggacgctgcggatgcgcaatgtacattgtccttcccctggccgtgcccccctgaccgttatagttacgtgtcacgtaccagacgccataaactggttccattcctgttttcattgctccgtggtggcgacgtacttcggattgtcgatggcatgtctcctgtttgagtgagcgacgcgatgaatatcctgatttcaaacaaatgaacgtgaagctgatgctaaacccagagacgcgggcaggtcggggccgaagcactccactcgacgctagcgaaggcggcgtctcaccgacactgcaaaccgatgtagaacgcactttctcgactgcaatggcatgtagctcgatgtcagccaaatctgacttccgctttctattgcaggcgaagcacttttcccttggtagcaagcgcatgcactatctcttcgctctgtcaacctccctcctgcttccccccgcggcccctcaccaatctctacgtctcccgcgcctctgaacgcccaagctagctgaaacctggccgtgctatctagttttacggcgacatg

SEQ ID NO: 7876 - DNA, 700 bp, Nannochloropsis_gaditana
  misc_feature (1)..(636): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcatttcccaccacccaagcggctcgccactggacctccctccctccctccctccctccttcc

SEQ ID NO: 7877 - DNA, 700 bp, Nannochloropsis_gaditana
ttgatgccttacatccgcatgaatattcctgaattcatcaataaaactggcattttccatgaaaaggcaccatcaaatgcttcgaatggcaggcctctggaggcaggtgccaccgcgctggaggccaatcacgaggacagcatctggagcctcgtatggacacctgaaggccagattctctcgggctccgtggacgaaactgtgaaagtctggtccatcccccccgtttcccctccctccgcctcgccctcttcccttcccccgcctccctccctcagtcttgcccataccctctcggggcaccggcttggcgtcgtctcggtggctgccagcgggcaacggcccggcctggccgtgagctgctcgttggactcgacgttgcgtttctgggacactttcaaaggagagaaactaggtttgggtgacctcaaggctggaatgggggaggcgtggacggtggcatggtcgtctacatcgcccttggtggcttctgggacgcaacggggatgcgtcaatttgtgggacgtagggggtttggaaaaggacggcgtggcggtgctgccctcggcgccttccatgaccttacgcacgcaggctcccaagggcggtgggaaggagggcgggaaggagggcgggaggcagagagggccgttcatttacagcgtggccttcgctccggacgggaagcaaattgcatgcg

SEQ ID NO: 7878 - DNA, 700 bp, Nannochloropsis_gaditana
gcaatgaaaggcttccaaaccccgtccgggtcccactgctcgctgttgctatggttcaggagatgggagcgttcaaatttgtggaccgagagcccccccctctacagccctttgccaaggtggaaacacgcaggaagtctcccgtacaacctgccgtagtctccgcaaagtggactgctgaggctgctgcgcgaggggcgatcgtctgcgggggcttattattccggtgcccgtgatttaatcttggaattcactgaaccctttccacctctagactggcggcagcagcgcgaggcagcaatagcctccccacccctcttcggccgcctaccccatttcctttcctagcgtcaaaacccttcaaaaaactgtaaattttatggtaagatagagaatcattgatgccttacatccgcatgaatattcctgaattcatcaataaaactggcattttccatgaaaaggcaccatcaaatgcttcgaatggcaggcctctggaggcaggtgccaccgcgctggaggccaatcacgaggacagcatctggagcctcgtatggacacctgaaggccagattctctcgggctccgtggacgaaactgtgaaagtctggtccatcccccccgtttcccctccctccgcctcgccctcttcccttcccccgcctccctccctcagtcttgcccataccctctcggggca

SEQ ID NO: 7879 - DNA, 700 bp, Nannochloropsis_gaditana
cgctcctcgaacgcccctttcctgatctctccccacactgtggtgcgcacaccaatcaaaaccatacatgtgaacgtattgccctcgagagagatatcaacctcatgtacatggtctggcgtaaaaatcgtcgaatttaacttgcggggccaacacccgtaaggtgcaccaaaaagcacggccaggcatgatcatggatgccctgcctgcaactttatacatagataagcaccgaacatcccactatccagaacacgaaggacacagcttgttaaattgggccaaagacgtgaaagggcacgcggcggccttgtcgatgcaatgaaaggcttccaaaccccgtccgggtcccactgctcgctgttgctatggttcaggagatgggagcgttcaaatttgtggaccgagagcccccccctctacagccctttgccaaggtggaaacacgcaggaagtctcccgtacaacctgccgtagtctccgcaaagtggactgctgaggctgctgcgcgaggggcgatcgtctgcgggggcttattattccggtgcccgtgatttaatcttggaattcactgaaccctttccacctctagactggcggcagcagcgcgaggcagcaatagcctccccacccctcttcggccgcctaccccatttcctttcctagcgtcaaaacccttcaaaaaactgtaaattttatg

SEQ ID NO: 7880 - DNA, 700 bp, Nannochloropsis_gaditana
  misc_feature (32)..(41): n is a, c, g, or t
  misc_feature (673)..(682): n is a, c, g, or t
gaagctcatcgggaggaagctacggtcggggnnnnnnnnnngagggagggagggagggagggagggaagggggcaaggcacctgatggtcgagtttgcggagaaaggcccgttccatctcattgatctcctccaggatgatgggactctccctctcgtcccagcccgtgaccgccgtccagatttgtgggaagtcctatccaggaagggggagaggaaggggagaagcgtgcatgtcaggggtgctaacaattctcccctcgaccctccgtcctcattcctcccctttctctctcccctccttccccccctgtctcccaaccttgttgcgcagcgctcggtcgtcccacgttttttgggcaatcatgaaagcgatcaagaggacccgccgccagttccccgcgtggagggtcatgtctagggagggaaggaggggagagaaaaaccggccgagtcatgcaatcggtcgccgggtccttcacagacaatatcccatttccaccgctcctccttccccccatcctcattccctcccttcctccctctccctctctctccctaccaggattgtactggaagagccgcatgacgaggatgagggccatgatgttgcactccggtgtccacttacacagctgatatatccgggtcaaaaactcccccacgtcctccgnnnnnnnnnnctgccgggaggaaatatg

SEQ ID NO: 7881 - DNA, 700 bp, Nannochloropsis_gaditana; identical to SEQ ID NO: 5255

SEQ ID NO: 7882 - DNA, 700 bp, Nannochloropsis_gaditana
atgcagctgggcgcctggacatggcgacagagaggcctgcgacgggggggttgcctgtgcataaagagggttgttcgtgcacgctgaggggcgtcaggcttggtacaatgtcaccacgcagcgagagaaggccttcaagatttgcacgctgagcccgggcgttgaagcttgggttgggttgtatttcgtcaaagggcaacagggggggaaggctagcttcaaggaagtcagcgagcgcagtcatggtggtacgcctccgcaccaaggtagagctaattgtgagctgggtagcgctagaagtagatagcacaatggttgacacgacaaaaaagacatttggagcgcctcagaggtcgtggttgatacgttcgcgcataaagaaacgtttttgggggctcagctctctctatgataatgttattagcgtcccaacctcccgtatgtatcaaaagcctatatgcacacgggattttacaagttgagggcccagcgtgtcattgatgtaagatttttcaattgggtatggttaaaatggcgtaaaaaggcttgtaatccaagtaaaatgctttttattttccatttcatggaccgcgtcatgaaactgatcttacgtttccatctgttctttccttcgattctgtgaatgggttgctaaaaacattgtggactgacaggcactgcctgtacatcagctctaatg

SEQ ID NO: 7883 - DNA, 700 bp, Nannochloropsis_gaditana
gaggactgtccggtaatcaagtgcttgcagaggtgcgcaggtaggccagcatcaccagaaagccctgccttctcatcccgattgcggctgatttatccccaatctttctgaatttaccccagtgatccgcgaagtgccccatcgctccctctccgagcccgaggtagattacctcaaagcccatgggtgcttggcaggggactggcgccaagtcagggtggtggaggggaatacactgcttccgggaaatgacgacgcttgcccccggatcgtccgctgctccttttatggaagagtgctgttgcatggaaactttgccgggaccgtcgacggctcggcgggcggtgaggcttgtggcttgttcgattccacggttgttgactgcgtggtgactggccccaacgtcttgatcaaaggcaaccagcgcctcgcccacgtggtgatcgaatcgggtgccatggtggtgggtaacggtgtggtggaagggcggggcaatgccggcgatcgggaacgtccctattcctgcgcgcgggtcatccgggtggggtcggaggtgctggggcgccccgtgtgcgtgcatccgtcgtccaggatgcctgaggtcttagcccaagctttccactccggctctgcccacgacacaccatctgatgcttcccttggtgcccaggcatcggacccatcggcttccgcgccaatg

SEQ ID NO: 7884 - DNA, 700 bp, Nannochloropsis_gaditana
cccaagggcagtctggcgtctctctgagcacggagtggcccattttcgctttcccagccccaagataggtttagaacggacggaagaaaaccttaggaaaaatcctgtagatctcgaaaacatttggatatttcaccattgcaactgtatattttgtacaattgacccgaaaatgtcctctttctctgcctcaccctattttgcagggccgtcctctgattctgatgaggactaatcggcccatcactctcctgctgtagcctcttacaatgttaacgtcagcctgcaaaataaaaatcgaagagccttatacattgtaccatagatagaactttttctgatggataccatgccattctattcatggctaccagcaaacctctataccgtccggacatgaacacggaaatagctagtagcgacgtcctcttccatgtggacatagcagcgactgctaatcagccggagcctgaccttttcaatgcgctttctaggttgctccaggagacaagcatcattgaagtcgcgtacagtttccaggagcaggtatttgacactcactttttcccttgctccaccctttttctccttgagtccttgtcaagttcttttttccatgcacggtttgcgcggccaccaatgccatgtatcatcctccatactatcacagacggcgtacctagcaacgctgtataccatg

SEQ ID NO: 7885 - DNA, 700 bp, Nannochloropsis_gaditana
tgagagcgcgagccttaagaaagcgttagatgtcagtcccacgtgacgaagcccaaccgatttagataacgtgagcacaatctcttgtcaaccaaattttccaaaaatctttaatgcaaatgagtagcttggatttttatttggctagaatgtggtgtgttctctgtagatatttcaacatggcaagagtgtcagcgcttgcgtcaatttctcgccctccgagtactactactagtaggatacccgggaggagagttgcgagacggaaaggtctcctgtaaaatcgtacggttctcgccttttgctgtacttgtctgcactgccatatcgagagcgagttgatagaactgacaaattgcatgaagggagaacgttgggtttgccttttgatttgctgtttcacagagacgcaactcccacggcgtggcttccatcgaaatatcttgctgctagtcataggttgactgaaatttcttgataaagtatcgaacaatctgccacacttctccagctctcactcagattgcagtgtttgcaacgattgcgtcttcacaagaatgttgtgaatccttcacgtgtccacatcttcctcctgtaacccttctgctaatgcgttcacaacatcatgttttcccctttcctctttccgattctcacgctcctctgatgccggtataccttcaaaagccaaagtatcatg

SEQ ID NO: 7886 - DNA, 700 bp, Nannochloropsis_gaditana
aatgacgtgcaaggacacgataaacgaggtgtgcaggcgggatatctgggcatatgtggtacggcggaaggccgtggcgtgtatcagggtcaaatggagatacgtagcgctttaaagcaagacgccaggcaagaaaggggaccaaaaactgaccattctcatcgatatcgttgaaaccaatacagtacagtcctctgataaattcctctgcagggtgttgtgtgcatcggatagtttacctcactttcccaaaataattttgtcacagacaaacaataggaaacgacaagaaatcatgtacctcacgtgtgccagcatccgcttcatactaattttggtagactgcctgtttctatggtatacgcacggagacattgattcagacagaaaaatgacgcaaagaaaatatcggcgggtgcccgttgctctgagcgagacggctctcctcttttgagagcgacaaatatcccgtaggagtgaattctactgcatggcagccggacagtaaaatttgggagttgtactgtgcgacatagagagttggatgtttcttttaacaatatccttcatctatcactaagtcagaagcacggagaaggaggggaggttgaagcagcgtgtactgcgtttttaaagcagccatgtgatttatctgattccttcttttctccaccaactttctaaagatatcaaacaaatg

SEQ ID NO: 7887 - DNA, 700 bp, Nannochloropsis_gaditana
ataaaatggcaatcaaacgaagtatccgaacccgattcctgggttttgggtataatttcgtcatcggggcgggaggcaattctttattccaattcgggttctcaaacccccctcccgatatttgcgggacagcccgtctaattgtttgtttcgaccatgcctgactcacggtatgaaaagacgcatttttgttttatctgcatggaacaaaaattgtacgacttatcgcctatatcgtcaattttatagaaatcgcgatgtaggcgtcactggatgaaatccctcagatatctacgttgaatccggggtcccgcagtatgagacgtctgggaacagcacgggaatagatgatttcatttcatgagcccactttctaataagaattgatatttgtaatatatcggcacacaggaatacgacgtccaatccgatttttccaatttgcacgaggattgcacagttttctcaggcaatactgtctggcggcccgtctacttcggaaataggaggggagaggtgatcagtgtcgtccaaataaatcaagggagtatactgacatttatgatgtgttgaatatttggaggtccatctggatgattgggagcgtgaaacaagggaaccaaaattctgatttcaccggccgctctgtgcgaggaacaaagggccaccccatccgcccatgaatctttcagaggaaatg

SEQ ID NO: 7888 - DNA, 700 bp, Nannochloropsis_gaditana
gaaatgcgcgagttggtctccaagagaaaaataaaggcgggagggagggagggggggaaggagggattgagccgagtgcttatcactggccattcactgggaggggcagtggcggcgttattggctttgtatgctgcggaaacatacccggatttacgtgtcgacgtggtgacctttggcgcccccaacgtgggaaacgctgcctttggccggcggttcaattccgctgtgaacaatcggcatgtgaggaaatggaaaggggagagagggagatgaggacggattaaaatgggcctcgggtcgcaggaatatgaataccgatgcaggaaaactctttgcttctttatacaggtcacgttcactggcagcggggcggagggcgaggcttactttgttggagattggatcagccaggtaagagggatgacagggaaactatggaggtagtcagggtcaagataaaaagagaaattcgtggcattagggaatgtcgctatcgtcctggcgggagggagacatttcttcgaaatctatcgcttccattttcccttctttccttccccgcgcgctcagtttccttcctatcctttcaataccttttccctttatttgaacgctctttactaggttccgtgcggcataatcaatgcctgtgacgactttaaagccagttcagatcagatggggggacgcgacaatg

SEQ ID NO: 7889 - DNA, 700 bp, Nannochloropsis_gaditana
attcaatcatataataagacaccggtccgtattcggtctgaatctacgtcttttgcatcaggctcgggtaattaatgccttcggcatctccacatgggaagccttctgtgcccaggcttcttgagcctgcggcacggcgcagcagcatcatatggcttttcatccttcttcttcttggttgccctcttagccgtgggctttgcgcgaaaaagtcgagcatggaagtcaacagaataagaagacggacacgtgaaactcagcccactgtccgagatgagctttcttccacaccctcccattcgacatactggcctccttccccttcgttccctaactccttcttcttgatgagaacctcttcccattttccatatttctcttctaattggtcatcattttcatcctggctctggcctgatggctggagctggaccgtaaataccaaaagtcgcgcgtcctctcgaaatacgacggtggccccaacatcctcctctacgacatctggcgctgacgaaggcaaaatagattacggggcctatgtgcgcgagcatggcgtggtgagtgacgtagggagaagatggattgcccgaaaaagattacaggtggaaaagacgactgacttgccctttctacaacacacctcttcacttaggtacctcaaggtggagagaatcctgcttgccccatccagagaagcatg

SEQ ID NO: 7890 - DNA, 581 bp, Nannochloropsis_gaditana
cttaccccctccctccctctctccctcccttccttcctccctccctccctccctgcctccctgcagcgagcacctggagtatcacgcgctggcgcgcatggggggaaagcacaggcatgcagaggcaaaggagagggtgacggaggtagtggagcagctgggtctgaccaaagcggtcgacacggtgattggaggaaccagccctttgttctcggtcacggtagggagggagggagggagggagggagagggggaaagaaatgacttgtcttgcatcgtttatctgcattcgcttgtggtgtgctgtcggagggctgcatcctggaagtccgtgactttcctcctcccctctctcactccgccaccttccccccttcctccctccctctctcactctgctaccctctcctttcctccctccctcttccttccgtcccttttccccttcctcccttattcagggtatatcggggggggaacgaaaacggttgaacgtcgccacagagctgttgacctacccctccatcctcctactggatgagcccaccagcggcttggacaggtgaggggccgcgaggatg

SEQ ID NO: 7891 - DNA, 700 bp, Nannochloropsis_gaditana; identical to SEQ ID NO: 4663

SEQ ID NO: 7892 - DNA, 700 bp, Nannochloropsis_gaditana
tagcgcatgtcatacaattgcaagggggtgagaccacataaactcgcaacctttttctagctaaggatggcgttgggcccctgagcgaggcaatgcgtgcgtggtctttttcaaggatcatacccgccataatctcacagagacggacaacacctgcatccagataaaagcatgctgtgtatacccactttaacatcgttattcctgacgtagggagagaaggccgtgccgtggcgtgttggggggaacgccgcaagtttgaggcaagcttgacgttggccgtccgctgtcatagacacttacgttcacgaactacctcggaaaggccacgctcgccttgaattgatcttgaaaggtggacgacactgacatgtcgtccacctatgcccaccgttgtttttcctcacatctctggttctgtgccatggatttctgtcaagtcctctgtggtagagactgtcgcaatttctcggacagcacgcactgatcctttgtcacccagtgatctgacttcagatctggaacacgcgtgtccctataagaacaagatcgacgctccgcacgactcttttccaccttccctcgcttcgtttgacgggccctagatgtcaagtgaccgtcgtttcttttttatatatctcgatacgtaaaaatatgccacgtcatgaccctctctttttccaacccttcttacagcatg

SEQ ID NO: 7893 - DNA, 700 bp, Nannochloropsis_gaditana
caccttgttcatatgaatgaaattcaagacggaaaagtgcgtgcggtacttcggcggagcgatgtgcaattgttgttgtccttcctgaggctgttccaaagcaatcagcaaatagcgatgagtaccatgaatgtagccttggtcttgtctcgaaattttatagggaactacttcgttcccattacgactgtctggttgttgtcccgacacatttgtcacgaggtgtaaaagttgtacctcgctgcgagagccctgcatggaagatgaatcaggatccaccaagatgaaagtgtaatagctcccatgtcgagcttcgatcaacttatacaccggatgaggatgatccatttctcctggaggaacttttgccccagagtcgaaattattgcacccaaatgtggcgttgacagaatatgcgcttcgaaaatcgtcggggagtacatcaggtatcaggcccgcggcagacagctcctgggagacagtcaaggccttatgctttaatttggtcattttcgatcctagattatgcattaatgatgtatgttttggtcatagccaagctattgatgtcttgtctattctaggatcctggtacatatagtacgttgctccatagacagcacgcacaattaatgcctttacaaggaatgaaccacagaacgaggtcgacaaaaagtcaaaatacaaacctggttgtatg

SEQ ID NO: 7894 - DNA, 700 bp, Nannochloropsis_gaditana
tggttgcaacagagcgttgattgagtatttctcgcctcccaggcctccgtctagtacagggacctgctctgacctcggtaccacttgttcgtgagcgtgattggatatgtagtcaacgacatttgtctgtatgatattttaagaatagcaatgacccaaagtctaacctaaatttcagggatgatgtgaagtgtttggatttttggcgtgatgatgggcacatattgcgactcgtcaatcttcgagcaaatttcacagtaaagatgatcgaggtagagagaaatgagagaactcgatagcaatggaaataatgtgataaaatcaagcaatggggagagaaacggcgtcttactgaccttatataaagatgcaacggagataacgagagcgtgaacaccatatccccccggatgggccgatggctactctggtagggcccgcgtcgcaaactattccctagtcattcccaatctagggatcccgtgtcgaaccgaccgggaaatctcgtttctcattactctcaaattattcgtcaaattcgtaggtggagagctgtcgattggaggttgtgaacgctttgcgtgctggcctagaggtttatagcccgtgagcggtggagagtgattccatattcgatgacgggatagtaagggtcaagggataagggacatcacttaccatccttgcgagaagaagtatg

SEQ ID NO: 7895 - DNA, 700 bp, Nannochloropsis_gaditana
aaagctgaacctcaaccgcatctacaagtcaccatccgtgtcatgacgaattggcctccccttgaccatattgtatccccaatctcacccgtcgtaccccggcaggaaggttttaagggccagaaaaggcagacgaccctctggttgatgaaggaagcggaagcttctgcttctgcctcttgcgtacgagcttgtgcaatccaatgtgcggtaacttttttccccccgccgcggctcgtgtagaactcaagacgtacgtagccaatgagtaatgaaacttctatggcttattggtgacttaattggctagttgatctgcataaagtatgttgtctttcataaacgagccatccccatgcgtcgctttaggaagcagcaggcggaagcggggacgggaagaatccttccctttttgcccctgaaaaggcataattgttgacgacctgtacggcattgcaccatgagatcctaatgcgaccgatcttagtgtgtaaataggcacccgcatgtctgcgcagtggttttaaaggacgagcaacccatgcaaagcctcgcgttgtctcctctcacctcctgtcagtatgtcccttgaaagctagggtagcggttctaaatccagttcgtttcttcacatacacatggacaaatattttcaacagtatcaagtctccgtcatacattaccactcgccttcatcatg

SEQ ID NO: 7896 - DNA, 700 bp, Nannochloropsis_gaditana; identical to SEQ ID NO: 4803

SEQ ID NO: 7897 - DNA, 700 bp, Nannochloropsis_gaditana
cctccctgtccccctttcagaagctacctttgatctccaggtcatgccaagacaggtttgagatggtggcacaagcggaagagggaaagacggcatccgtcaccatcccttatgctaaacaagttctcttattctaagtttagccccttctctgatcctatcttttatcctagcctttagcctaaccctagccctaatcctaaccatgacgaatcaggtttctggccaaggcaagaaattaatgagggccacgttccttgcaagagactgctaattgtgctctcaacacgattaatacattaggggcagtttttgccaccctaccattcgtttacgtgatattatactaactcaggaactattttgtgagcggtagtttgatgcgcaccgaaaactttctgatgtcgcgagttgacaacaagatgttgctctcgcgcttcggcgacagacccaggtatagaagactaggcaaactaatgtgctatttctcaactttgcagcacacactggctccgaattcatcgcggcatgatcaacagggtcgcgggtgtggacgactttggcttcttctactcctcaccgatattattggaggagattgatttcttgtagcgtggtttctaagggccctgcaggcgaattactatcccccgtccggacagaacccggcctgccgtgtagccagccttacaaatacatg

SEQ ID NO: 7898 - DNA, 700 bp, Nannochloropsis_gaditana
ccatcagatcttgtcataaccttgccggttgccactgccacaaagagactgttgccgtatgtgactgacctccaaaacgtctcctccccagacgtctgtgagcgatccacgtattcgcatctacactggttatgacccatgtcgttgtaaatccgacagcgacccattttgaatcgccatagccgatgccagtgtatgcgctagaagttgggacggtctgtgtctgactccaagttgccccatcgtcattgctgaatgcaatgcttgaaatcgtagggaatcccacatcgacggcgacgtacgttccgtcgtggtaggcaacagcattgaggttcccagtgcttgtgaaaatactgtcccacgatgatccaggaccaggcgccggcggggcgtggcagtaggtgagggggttgggaagggagtgggcaacgcagtgggcgacgcagtgggcgcggcagttggcgtggcggtcggcgacattgtaggcgtggaagttggtgtgcctgtgggcgtcgcagtaggcgtggcagtgggcgttgcagatggcgagtgagtgggcgacgtagtaggcgacgcagtgggtgtcgctgtgggcgtcgcagtgggtgtctcagttggcgagcgagtaggcattccagtaggcgtgacagtggggtaggccgtgggcatcgcagtagtcaaggaagtgggagaggtaatg

SEQ ID NO: 7899 - DNA, 700 bp, Nannochloropsis_gaditana
tcgactccgtacctgctgccagtatcgatgcactttaatgatttcattcctgtttttctttcttctagccactcggtacctactatttgtgcgcttttccaattttagtaccgcaatagttctccgtaacaaccactctgtaccttctcttcgtgcgctcttccaatattggtacctcacgtagtttgccagctaaaatttgtttttcgaaaaaactctgtcactattttatacttcatatttcttggcatttctgttatagcacaggaaatagcacagaaaacgcaccatgtcgctggcatcctctagatttaaagttttcgcgacgaaaactttcaaagtggacccttggcttcgggctcctcctccgccccagatgaagtaccgaaagagcaagtgatgccaactttttctttaagaaggcaagctgcacagtatgaacaagcaggaaaaagaagacaccttgcttaggcactggaaggcaatcaaggaagcagtgcgccgttttcgaaaccatgtgagatatttgctgatatatgttgcatgcatttcgaatggagtccattaattcactgttctccttggcacaggccaaaaacaggatcaaggagtgcatgtccaagaatatcaacatggacgtcctctttcctggacatgaagagcattttcgattccacccccttcttgtctgaaaacaatg

SEQ ID NO: 7900 - DNA, 700 bp, Nannochloropsis_gaditana
gagatgaagttaagctgcagcagctcggaatcaggaaattgtcgacctcgtgtcgagtgcagagcatccaagtgcatacaaatatcttattggctttgatcagtgttgcaacatttttagggcgcataagagcgatagaaggctcctggtgcattcgtaaaggcctaatgaaagaggtctgggagggtcctaggagcgagagagcgaaacgtcgccgaaaggtaaaggatttgaacgcctgggcgcctttcttcgttttttgcggtaaaatcttccttaaagcttgactttcgatgttttcatctgctgaaaattcgattctgtgtctgctgtccacgcacctactcatcacacgacggtcgatgccgagatggccctccatcctgtaaatgcatggtggctcagggcatgcctctgtgtgcgccaagtatatctgggtgtagcaatggagtacagaaaagtcagtgcccggaacaagtgctggtctaagatcatgtggagggttttctcagggcaatggagtttcttaggacgtcggaaaaatcgatccaatctatcgcacctgcacggtttaaaacgggacccctcccctacgaaggtcggccttgactgttgtgccgacattcccatttcttcatgcatgcatagacacccagcgctctttaggcgcatagtatagtgcctgccaactccagtcatg

SEQ ID NO: 7901 - DNA, 700 bp, Nannochloropsis_gaditana
ttgcaccccctgccttcctcgccactcaggtcggcatgcttcaaaacattcgcgccatgtcagccgctgcctgagcacaggacccgaacgcgacgtgcaagaccgggtgtcgcatgcgttggacacatgcccggggatggaggaggtgggccgacgccgtattgagttgctggtgcataacgtttcgcacaaggatatggtgctttcccttgctacattaccgggcctgggtccttccaggacgccctcggaagagctattgagtcgcacgtcgtccacttcatcgaccgtgctccgggtggggccactggcgccgttcacggcgacacaccggcgtcgcacgagcagcagcgcggtgatgcaggaggatctagtcctgtgtcggcctaaattttcactcttccagcccgtgagtgacgccatcctgcaagtcgtccaccaccacatttgtccttctgtcaaagttcccgtctatgtccgtgagcacaacccctctgctcccgccgccttgccaggccccactccctcttctgcatcctcctcggacgccccctccttgcgaagaggggacatgagacacgaacgctcctacactctacgccgccagtccctgacaacccagccggaactaccggtgggctttgacctgagcgagtgccctctgcctgtccaagatctgaccgacttccgcctgcgtcga

SEQ ID NO: 7902 - DNA, 700 bp, Nannochloropsis_gaditana
aattattttgacctgcagcccgtgccgtgcacattcaagcgccgccgtcagccccacgggaccagcaccgcataccaaaatcgtcactttttccgaggcggaagcaatttcatgctcctccgtggctgtgtcggctgcggcagcactgccggaagagcgcaatctaccaaaccgattactgctccgatggaacatgcgtgactgcggtatctgcggacgccgatcctgctatattcgacgtgccctgcacgtacattgtgaatagttcggttgatagtgggaatctgagggtcaaattgtcctttttggtaatgcttcttgtagtacaaatgcaggcatgtttgttcaccacactgcctttcctctcgttcctcttgttgcggttgagttgtctctccttgttccgtctggtttacgcgcctggagccttgactcaattttccactattttcttagctccttggcatttgttcaataattaatgcgctacaagcttgtaaaaaatgagcaagtcttgtttgtcgtagagctcgagtgctggtaggctcagacagacactctgtgacatagtcaattgtccgaacgggcatagcagtcgtgttgcttcaagtagtatcctggctcgatttcgtaggcatgacttcctgcctccacttgtattcttcccgttgtcgcgctcacaatccttacacgtggtacc

SEQ ID NO: 7903 - DNA, 700 bp, Nannochloropsis_gaditana
cgcgaggaggagagttatgagcgaaggttcaagaccggattcacgcgaggagaggcgtggcaatgcctcctacctttgtcttcggagttgaggttcgggagtgcgcgccgcaaacaccatcggcatgtacagcaccacaagtgaaggagaacacgccgattcaacagccctgacatttctgaagctgtccatgtgccgcacgccggttgcaggcctggaaaggcaagtgcggcggtgttatgcaggctgaagtggagttttgtaatttcgcgaggaaacggtcgcctggacgtggcggccacagacgcacaggctcgaataatttgcacccgatatgtcctctggccccgagaaaaaaaaagtttctcgatttactgcgctctgcagctctacggttgtggtcgacatttttttgtgctattatgcgaagaacatacgcagaaaattttcgctttctctgactgcgtaggaggacctaacgaggtctgtcttctcggcttctcaaagcgtgtgcttgtacttttgtacgacccagcttcgtcatttttttacccaagctaccttttgccaccaacatccgcataacttttagcacattttcaccgacacagtgggggctgtcttgactctatctcagctggattcgagggagtcaaggacaagggctaggcactgaggggagcaacagtctctttcaatg

SEQ ID NO: 7904 - DNA, 700 bp, Nannochloropsis_gaditana
atgggacgaaaacaatgagaatttcgtggaagatcaggcttcatcttaacgtgagttaggatcagcattaggacaaacagttgacgcgcagcccccatgtaatcccagcccggtatgcagcggtaaagttaaaagacacacttgcggatttttttttctacttggcacacaagacagattcacaaggaggcccaccggtagaggtgtgcgatttaccagccccatccattaaagaagtaatgacaagcgacataagaaagagtcaagattggaaacgaccctcggacacatccgcaaaaatacttttactttctcaatggtccatgacgtgacatggcgtttgccatagcaaatcgcttacaacagcggggcagatgctgtggtttgtttcagaccgagcatttcagcatatagaatcccccatgaaacagtcaccctccgcgtttagatctatcatgtacaggcgtgcacaagacgcgcatcccctaccatcgccaacttccacactggctacccctagcaaataatcaggggagctttctgccccagcagcaaggaggccacgctgtggaggacacggtctgccaccgacactcccgccttttcctcctcgtccacaagcactcttcctattcgcttgacacaccgacgagcaaccatctccctgatgctggtcagtactgccatggccgtagtcggt

SEQ ID NO: 7905 - DNA, 700 bp, Nannochloropsis_gaditana
cgtcaagaaggacttgtctgacccctgtgcttacgtggacgtgctttaaacaggcttgacactctcgtttcttgatctggaaccgcgtatgaagtcgcacatgtacttatccccacgtttcttgtacgttaagcgttatgcgcgtgaaaatgcggcttaacttctatgatcagccttctaagtctaagactcccccggcatgtcccttgcattgatcttttctgcacaattcaatgtttcagtgaacgataattgcacataatcatccttgagttttactgctcaaagccacgactgctggaattgaattagaagtcgcagcagcccttaacaaagtctcggtgtgacggaacattccagacccattctttcttgagcccagccttttgtggggaagcaacaggcaaaacaacacgtgtggccatctttgaccccgtgacccagcatgcacgctcgcactaactgcctacattggtgatagtgacctcgtcgcccggcactctttctcccgactgacatatcatgctcttcctctttgcgccccccccttttccaggtattatcctagccacatcgcctcgtcgttgcattcctggttggatggggtgcttgggcggggcggcggcaccatcgacttgaagaactccgcaacattttgtagcacaggcggcagcgaacagaaaattagggcgcattgatg

SEQ ID NO: 7906 - DNA, 700 bp, Nannochloropsis_gaditana
gggactcgtcctcgtggaactctgtgcgagaggaggaagcccgcaagctcgaggatgaggccgcgttgtcctcttcatcctgagcgcttcgactttgagattccgaggcccctcgtgcatctcgcccatggatgggatgagcccctttcttcatttgttcctgtgcgttcacgtcgtgtcgggaaggagcgaagggggggaggttgaaacgcactattgcatgctccagcacagcccattgccacctgacagaggctgcagactatcgcgcgcgagtaaagcaggacattgatcgacataatggtcatatgtgggcacaattgcggcaaggatgcctagaacacaagcaaaagaggacgtggaggagcgtacacgatgatgccgacgcattcgaggcggtcccatctcccacgttcgtgaggcgatggtaaggctcgcaaagcaattaagaccgaaacagatggccccttacgtcttgcatggataggaaatgagatggatttcgtgatgctcgaatcggacggggtgtcgatgtcccagtcgccgtttttatgccaaagccaaagcccgcctctgagggacgaggaaactaatgcgtgaggcagttgtatgcaacattgcgttcatttcacctctcgtatgattttcaaatggaagacaataacgtgtacgcacgccatacagggcaacgaaggcgatg

SEQ ID NO: 7907 - DNA, 700 bp, Nannochloropsis_gaditana
  misc_feature (1)..(538): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgtcatgcactcggtttgcagagaagggggaaaatcacgttttatgaatcaagaggcgaccgttgtctttctctgccggcacggctcccttcccttgccactcacctgttccttctccagccccgccttcctcccccctgcgagcgagacgtgcgcatg

SEQ ID NO: 7908 - DNA, 700 bp, Nannochloropsis_gaditana
  misc_feature (1)..(677): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcccacggcggctccgaccatg

SEQ ID NO: 7909 - DNA, 617 bp, Nannochloropsis_gaditana
tcttgaacgacgtacatgtgaggtcggtcaatagtctgtcacagcgcaatatatcgtccgagcgacaacaatcataaggttgaatggcttcatgccaaaggaaggtacaatgcgcaagtttcggcaagacagtccgactgtccggcattggaatttctgtactgtttatttgtcaaggccacattctcgaaggaaaacaccatgtcggacccctacaaattatttctagtggtacattttcctcgagacaacatatgcaagaatgctggagcaatagcgccggtcgaaatgcattccagtgcctccttatgtaaaggtctgttggctgcgagaaaagtatattctcttaagtcttgcaagcagcgttctttccctttcaaagagacaaatagttcatctccatatttctacacaaagttctggaatttacgcctcttacatttcaaattcatggtgtggcttcttgttttctttttgggacctggctgggaggcaaggaggctgtgaacagatcggatctccgcgcgcgggccaaccaagttggaaacgcacaaaaccctgcgatgaccatcgtctcacattgtcacgcaaatcacagccttgtggagacagcaatg

SEQ ID NO: 7910 - DNA, 700 bp, Nannochloropsis_gaditana
ccccctccaagcatcataccaggctgtgccatgtagctctgtccatcatgtatgaggaacgaagcccgcagatcgggaggaagactgcaccccaaagcgtactcccaacgtcccaacgcgtcttcctctattcctttgttcagtgtccaggagaatcctgctggggcgaattgctcaatagtggcccatgccctccgcaaacgccagagacttgctttccgctcaatgaaatcacatcgtatgttttgcacgatgtctgccggcgttaggcacgagggtaaagagtggagataaatgggaccgaggtcgacgcatctccacgcgttggcatgtttaatatgactaaatataagtttgcaggcacactccaggatcagccaagagcttgggggcaaaaatgaaagtgtgatgtccaaccaaaatgatgtcctgacagcagcgcccaagaaagcactgaaactgagttgagctgtgccagcgcttgccatatgagtactggaggtgacataatcaagtcgaagagggggaaggaggctacggtagtagggcttcgaggaacacaggacataagtagcctgtcgtccctcggaaaacaaatggacatgtacgagccttgtcatacggcaaatgtggttttcatggctgtgtatgtataagagccgatgaatgtacagtgtgcgtcaaaagtggcccgaaaatg

SEQ ID NO: 7911 - DNA, 700 bp, Nannochloropsis_gaditana
ccacctgagcaacaggcccaccatttttttaattgggctcgcgtctaagtgtttgttttctttatatctcaatcgaagaccttttggtgtacgagagagtcttcccttcattcttgcggatgcatcatagctgcatatgacagcaatgtgctcggtacgttgttgttcggaagcgatacgaagacgataccatcaagcagacgaccggagattttatgaacacttcaattggaagtgtcgggctctaggtgtcaaagtgagtaggttttatgttccacctgaatttcctgagcctcaaaacacttcgactcggttcgcacaaacgaaagattggcaagtgtgtcgaaaaaaagtgtcgacggggaaaaaagggaaaaaacggaaaattccgggaaaaggaaaaaggacgaaatgcgacacttgtgacaacgatccctccttgggagatactcaagccccggttattgcctcggtctttaaattgttaaaagtgctcaatgccaacacatgttgttggccgaaatcgcgctttcagttgttaaagccaacttttcatcgtttgacttctggtttccgctgtattgcaggggttacacagtgccccactcgatttcaggaggagtgtcgacacaatgactctacgtcaatcatgactcctttaatctcaaatccatactaactaaatacaggaaacaatatg

SEQ ID NO: 7912 - DNA, 700 bp, Nannochloropsis_gaditana
aagtaaagggtgagttaacgactggtgtaggacatgacaacctcctcctatggaaagtcagcgacgcgacaggcgagagagtgccgtctgttgctaagtacacggccgtatgaatggatactctgcatcgcttctttcgcaccatgcaatcaatcaacagactaaatatatatacgcatgtatacaatttttcatcgttggctttgacgtgtgagggattgcgacgaatttctcatggtcaccgccctccgcgaaatactcaacctccccattcgccaccacacagcaaagcgcctactatgcgccaactgcattgaactggcaaaactcagctgtgctgtgccccatggcatatttatatgatagtttcgacgaaattgcaaccaacgccggctgttggcacgcgcttgagcatctcgcctcctcctcctcgcacacgccccgccgccttccagagtcaccatcccgcctagactggcacatcgacgaaggcactcgcctgctcttatcctacccgtccgataacacacaaaagaacatggctccgcaatcaaggttttctcaaccctcattggatatccagcccgctccgctcctccctccgggtgaatccctcgctgaccatccagatctagtgtgggcggaggacatcagaacagaaggagatgaagcggccgccgccatgtattgcgccacgcag

SEQ ID NO: 7913 - DNA, 700 bp, Nannochloropsis_gaditana
  misc_feature (1)..(561): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccctcaccaccacccccaccacccccactacccactcagtcatcatcaacaatgtcaatcggctccacagacagcagggtcgctctcaacggggcctgggtttaattttcgggggcctgtctacccccatatcatg

SEQ ID NO: 7914 - DNA, 700 bp, Nannochloropsis_gaditana
gacggcgcagtgaaatcgaataaaacaaagctctcgcatgacgcaagaaagctcctcctgtctttcatggtgaagagaaggggtaaaaatgagcttccgctccagcttgatcggtttggtgtttcattgacacatattgcggcatgttcatccagggatgatctcgtcgggttttaagactcggtcggggctaccgcagtgccctgggtgtatccgatgaaactccttgcttgatacatttcgcctcataacttacaaatgtgttcctcgcgcaaataaattataatgattcgtgaaatgcatcctctcggagcttaaaggttttggctctctggaggtcttggtgctttacttgaaaggttagcacgggtttcgactgactatcccatgcatgcatcggtccagtgtacggcgtttttaccctcttctcaccaactgtctcgcacatttcttgataggtgtgagggatatgcgactctcgcctcgtgaagtagacaaattactgcttcagcaggtgggcttgctcgcacaaagacgtctggccaggggcctccgtttgaatcacccagaatgcaccgctttgatagccactgttctcatagaaatgatgcgagacgggaataaaacctgcgcggagctcatggatctaggtcgttgtattcttggacatcggcaagtcctcccggggatcgcatgcatg

SEQ ID NO: 7915 - DNA, 700 bp, Nannochloropsis_gaditana
gcacttgtgtacataacacaccacctcaccatcagactcagaagtaagattttttaaatcgtgagacttaaattggatattttaaaattttccagagattcttcagacaagaaaaggaagccgacagtcttgcaattatggtttacttaaaatcaagtgactttcggtcttggtgggcaaaagttgaacaactaccccttgcgtagcaggatttgttctcatagcaattagggcttgtgtattagattcgtgcttgaccatcgcctccacacatgtgagcagtattgaagccaaggagcatcaaagtataaattcttaggtgtgtagcttgagtcgatgtgaacacaagttgccgacccagagaataattgaaagaacagcgcaatcagtcaacctccctcacgcgttttgaatttcaactgacatttgaaattcagccgttagctttttctctctgctgcttgcaactattaatctgtcaggcaaccaatctatcatcgtgactgctttgatgtattgtcctggctaccacaaaatcacaaaaatatgctatttttaattctactggtttgctctttacattaatcagtgagcgaagcgacaatttcagtagtccattctcgccggtccatttcgccttcgcgtatgcttttcgtcatcctctcgactccacacatctttcctttcccaccgtacaaac

SEQ ID NO: 7916 - DNA, 700 bp, Nannochloropsis_gaditana
tatctgtcgctggaacggcaggtgtgcccgattcactcattgcattccatccaagggcttgattttcgttgctgccgaagctgtgtatatgtatccttactacatcccaaaatttcgaataagaaattgagcccgtcataagatatatcaaatcgcgcgtgcattgttttcaagtgtcatgatcacacgccatgaatccccaatcatcgtgcgatgagcatttgctagtacgttccgggttctgtatggcccagttttaaaaagtcatatttgatgaacataattgccttaaagcccgtaaaattttgatgcttctttcaatgtcctcgcattgaccgttttaggaagtcgaagaacatcttggaagagtctgtaaaatgtaataaccaccccgacacaagtcaagctgttggacttttttaacggctgagctcggggggcgtcatcgacgtgatggaaaagacctcactctctgcccttctccatgtgatggaaaaggcctcaattattccacgaccccaagaatgtgcgtttgctgaatttaagtagggggactgggtatcaacctcacaagctactccagacatcattttttctagtttctcacgcgatgtactccgctcctacaggattaccacgctcctgtccttgtgatccccttcatatacagggaaattcacttggctactaagctggcatg

SEQ ID NO: 7917 - DNA, 377 bp, Nannochloropsis_gaditana
cgatctccgcgaatttaggcaacttcacggggggaatagaacatctcagtaggtaaatgatgagttgaaatggcaggagcgctgccggaagagtctaaatttattacatgacagggcctgaattgcaaggatcacatggatggacgaagcatcgactggaagtgaatctggtgacgaccaattcccatcgggagacgctatgtctacgttctttacttcagataatgaaatggtcgctcttatgtgtccgatgttcacccggtcttagacccccttccttttaaagcttattaaaaattgttttcgatccatcccatcattttctcgttcatgtgaaccgactttgtggccaagcgcacagcagccttttaatcatg

SEQ ID NO: 7918 - DNA, 74 bp, Nannochloropsis_gaditana
ctatctcaccctccgtcccaccctccttcgcgacctcctctgcttccagcacatttctggcgccggagccgatg

SEQ ID NO: 7919 - DNA, 700 bp, Nannochloropsis_gaditana
cacgccttaaacaatcaacgggactatgatccatgtgcaactttatcatcagcacattcccatcggctattattcagcagccctatattctgcgtgctcgggggttgtatcatagtaagtatcatatccggcaagattgaccaggtttgaagcaaaaacaaccatttcaaccgtagtttttggcaacccgatgctatcgaagcgggataaaggcctcgcatgcaaattcgaagttcctctgcgggactggcccatattaagtgttgtcgaggcaacgtccggcttgcggcgtccgaggacggtcaaatgtttccctgaggcaaaagtccgttcagtctgtcaggagtcgtacggatagatgccccagaaagagtcacgaaaggaccttgttcgcagcatgaggtggatatcaccttgtctttgggcgtttcccacgtgctgtgtggttcattcgggttgggagggtcgcgggtgacgatgaccacctctttctgtcagaggggtacggagatgctatgattgcagccaggcccacactatcttctatgcgtgtcgtcatgcatctatgctctcttaacacgtgcatacctgaaatccatcacacttgcgggtgtttacatattattttcttcctaccgtcatccaggatagacgtctttcactcgtgcaatcacctgtcaagctctgtaaactgcatatg

SEQ ID NO: 7920 - DNA, 700 bp, Nannochloropsis_gaditana
catttccaaagcaaacgccaacaaggtctacgtcgaatctaggaagtaaccaaccaccagaaccgttactttttcaggtgaaaaattcaaacaaccaaaaacagcgaaaaaagcaaaaaaagcaaaaaaagcaaaaaaagcaaaaggggcggcgagagaagtttctcgcagtacttgatcattgctcctctggtcctggtattcgagactaagtcatctcctgcacttgtgatatttgatggcgacgtatccaaccctttccatcttgctcatctctacttgtggtcgtgagtcgacacgcacggactttgtgtaccagtcggcgccggaacacgcgccatttcccgcgctacaggcaggggcgagagtatagagtacttagatacgtttctgtgccggtcgaggacctctctaattgggtatgaatgattgggactcggtggccatatggtgtattttattgctgcgaggactgtacatccgtgcttatactcttccggcagagaagtgggtgtcaatcgtttctcctcgtggatttttgcgatgcaagctttccgtatatctcgtttgtgcctgtttcgtacgtcgtaccgtgactgcgagcaaatggacgctgctttcgcaacatcttccaggtctatattcattcctcctcttttccactcatgcctcagagacatcacacccttttgcaatcatg

SEQ ID NO: 7921 - DNA, 700 bp, Nannochloropsis_gaditana
ccctgccaaagacttcaaagccccgatgagaccattggtaatgccgtccatcatggcgtaggccacgcccttgctccgtctggaagcgcatggaaacataaagggttcgggattttaaataaaaggaagaagaaggaaggacgtcaatttcattgtcctgcgcgcccagtgactattgtacactgtgtgggagccgtcaagccaacgaggggaccgaggggtgagaggctgcagaggatgtggaatcaaatgagagacacttaccctgagctttgcgtcgaaatggttgtcattggtcctttgtgccacgatttacatactccaggaggcggaacgcgaaatgcatgcgaagggaagacgaaaccataaaggatgacgaccagggggaggaggtagataagagggctatggcgtggcatgacgagcttccaaaaacagagattaagctcaggccaaaatgctgtatccccggatcgtggtgtctctgttatagatcggcacgaagcaagtggaaaattgagtttcggggttcaaagacaagacaaatcgagtctcattaattaactaggtaaaaatcttgagggagcccgtcttgaacgtcccgacccgcttactcccttggcgactcttcaggagcagacatcgatgcgatttattcaataagacgacacgatactgaaacaggggcacgcttaccatg

SEQ ID NO: 7922 - DNA, 700 bp, Nannochloropsis_gaditana
ggattaggatagaatcgagagcaacgaatgcatcacaaaagcgaagattatcttgcatggaaccctcttgacataagaggacttgtccgaacaatgaaaatctaatcacgaaccttcggttgaggtttggttgcagcagcaaaagcatgagcaaaccttgagcttgccatgatgactatgatgaggaagcaagccaggagaccggcgggaggaggcataaataacaagtaccgagtgagaggggggtgccacactctatgtgccaacactctgtgtactagtgcatgtagggtacgcgattatggccttgcgttaacggcacagaccacttccatagtcaagatacctccctgtcactgactcggtggaatcaggatttgaattttaaaaaaagtttaggcggaggagtaacggaaacggcgtcgtttcgtcacctatcttatggcgtgcgagcgctttacacacctatggagctctactgccatcataaaggggctatgaaaatccgcttttaaccagataggagggtttaattgatgtggttctctccatgaggcaagcatcgttgcgctaagtgttctctatgagatttcaactatacgtctactcggttcttcttccatttctgaccagttctttttcttcctctttaaatcagacgccttgatcctccttagctctaagaacttacatctagatg

SEQ ID NO: 7923 - DNA, 700 bp, Nannochloropsis_gaditana
tcccttttgctcgtgcaggcgggacagcgtgcttgccgtgccctgccccctattggtcgcattgtgcgtctcccgctgaccgtgcacgtatcgcgccgcattcacgtccacacccaaacggaaactatgacgacccttctcctcgcctttttcatcgcgttcccgggcggttttcaggtaatcctcgagggagagaaggtggtggaagaaggcaaggcgttccggggtagaagggaagacagagggagcactttcccagtgcttttccagaaaggatgctcttttaccttccccaactaaaaaatccaaggggtcgcaggccagttgctcaaaagctctctccaatatggagaaggatggagacgagtgggataaaccggctaagggtgcggcattgatcgtcatcgtgctggtggaggtgccttcaccaggggaggttttgagcttcgtcttctgcaaggatggcgctgtgaaggtcacaggcatggatttccgcttcttgcccatgttgtacctggcttgatgggactcggtactttgtgccgtgtcggaaggggtttgttttctgagccagtatctcctcaacgtgtggcaccaacgactcggatggcggcgtgacgacacgcgatatggcagactaggcaggagccacagataggacaacaagaggttcacgtccaacaattctcccttacgcatg

SEQ ID NO: 7924 - DNA, 700 bp, Nannochloropsis_gaditana
  misc_feature (1)..(550): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgcctggtggacggtgcctcggggcatatacaacacgtctcccgggctcagcaccacctccagagagggcgttccgatctcctcctgcttcaagtccccgctggcttgattgggcaaggcaaagttgcccatgggggcatagagccgc

SEQ ID NO: 7925 - DNA, 700 bp, Nannochloropsis_gaditana
tattgtgccaaatatcctttttttccaaacgtagcatccacaccccatctcagtaaggcaaagaattcataatttaatgtatgtcttcagatcgtacgtgtgaaagcatggatcgcagtcttcaagatagcacgagagggaaaatgtgagcggtcaccacttgtacactgtagtaagcctttggttgaatgcaaaccaaatatgaatatattgacgattaaattaaatgaaattaggcggggaacaaaaggaagtcacgggtaaataaagaatatatacttaaggttcagattctgggtaacaacgacacgacaattttaaaatttgaatttgctgaacgtttctcccttccctaagaagtacgcgccgttgcttgtctaaaaggtggactggaaactcttccgatacagcaaatataggcccattcgagcatcttaatcacacatatgcatatgtttttctatggtattgatattttcttcgcccctggaaaaatatgtcaggctgtcagacacgcaggtgtccgcgggagcaacgcccattaatagagaatttgcatcccccaacccttcctcttcgggaccggctagtttgtttaatgttgatagcccatcgtattcggtagtcgacgcatcctcgtttctgaacgtacttatcagctcaaacacgtttcctctttgtacacaggcaagacaccatg

SEQ ID NO: 7926 - DNA, 700 bp, Nannochloropsis_gaditana
gcagatacccacagcacagtgctcccttcgcctaccttttttgctgaagttacggacggcttgtgatggtagccccgatatgacaggtggttgaagaagagatactgtcctgctaatacaattgctttgccctccgaatgccctgactaatgctcggttcatgatgctcttggttctaggggaaggcagccttctagagaggtgccgcatgcaaataccacttgaaaacgatgacatgagacgttcaaatgcctttttcgctagctgatgtagccaaaaatttctcgaaagaagactgtggacgggaagggcgtgcttggactgagatgaggtaataagacctgtttcaggggcgacctctctggtgactccgctactcgccagccggggataaatgatgcttttgcagcgtcgccaaaaaaaaaaggaaaatgaggccgataaccacgatatcaagatcgatgtatgagcacaattcacaatcctggctgttttaataaatattgtcgtgtcagtggtctctagtcgatgcatgtacccagtttttcgtcagtcaacctcccctgcttgcttccctctgaaccagtttactttctgagcaagggacatgccgcctcgtgctagcccataaatgtcacagcaaagacgctctgtggctcccatttttcaagaatcacgacttcggtaggccttcaatatg

SEQ ID NO: 7927 - DNA, 700 bp, Nannochloropsis_gaditana
gatgatactgtggaagtggatgaccgctgaggcggagtgttgaggtggaaatcgtgaaggacctcagagcttaccggcggaggcggacgacaagtaccatgtccgatgtctcatgtaagggcagcaccccctgaagtataggattggccagaagcttttgctcatcttcttgggaaagctcttccgtgaacgatggtgctgcggcggtgtccatttaaggttacgactgtgcagcaacaggacagataccgtggtagggcggcaccagcataaatagaaagcctgcagccaaaaaatacgcgggacggcggtaagattcagtagacgattgccaataaattgcaaaggcgatgttgtgcaaatattgaagagggaggagagcactttgtcgtgtacggtaaggcgcacgctgcctatgtcgaatgcatgtcatgcttgttagttagaggaaacggctggggagcattggcgacatgttttggttttttgggaggaaggaaaaaatattaacaagacgctcaacatcaaatgtactttgcccgctacagaaaatcttccattcgatattttacaaaagttcatcggtttgaagccagaatgaatcgacttgcacgagcataataacccgtcaactcctcggtattacgaatctatcaccggcagcctccctacagcagcagccattcataggactggtatg

SEQ ID NO: 7928 - DNA, 700 bp, Nannochloropsis_gaditana
ggtgtgtccaggccctctccctcctcctcctcctcgtgctcctgtaggtgggacgcgtcctcccctaattcttcgtcactactgcttcccaagctccccgccccgtcctcttcctccgcgtcgtgcccgttgtgcgcgtcgttttgtaaatgcagggccttgatgccagccgtcacatgccctagccccccgttctcttcttccttccctgacccccgtggctgctcttgcttgccaagggaagcacgtggcaaggaggccgcagacgctgcggtccattcttgtggcaggcccaaaaaagctgccgccccggtgccctccttacgggctccaggctcataagtccctccgtccccgccccggccgaaaggagtgtaagcgtcgtcctcctcatcatagcccggggtctcgaactccaagaaatcgtattgctgtcccccgggatcgtgcgtggccatctgggacgtgtgagatagcgcggtgagtgaacacgtgcgggcgtcacacgtcaatagggtgcgtggcttcgggcgaaatatcgtccggaggggggcacgaggttagcgaggagactctccaggaacatgtcgttctctgtgaggggcggctccaaattcatctcctttcccaccgccggcaatgtatactaacacccacgggcactcacacacagcactaggacaggacagacacaagaatg

SEQ ID NO: 7929 - DNA, 700 bp, Nannochloropsis_gaditana
  misc_feature (103)..(112): n is a, c, g, or t
gcatacgtgcatcaagtttccgcccctgacatgtaccgtggccggtatcggtgccgtgaaaaggagccacgggcggacagagcgaaccccccgccttcaaaannnnnnnnnnatttgcgtattactttattcactaatttattttatcattgagtggtattttcttcttgagaagaattgatttattgatgtatgcgtcgtgtttcatatctaccatgtgctgtatgtggaggtgaatgatgacagacaaagcatgcgtgcacagaggtttgtgtactgcaaaggccgccagtatagtacataggcgcccatacgattgttcggctcgagtcgccccatggcgcttaccagcatttccgtctctcgcagggggtgtgccccgatatcgtcacgatggggaagcctatggggaatggctttccgctaggagccgtggttgcccggagggaggtggctgcggccttcgttggcggtgggatggagtacttcaacacctttggggggagcaacttgaggtagggtcgagggagggagggaaggaaggagggagggagggaaggcgccgccgctggtagggcaggaggtgtgcgagggggaggaagtctagcttggaggtgcctacctcgaggcgctctaaattcttgaggacttgtgcccgaccgagtgccttcattctcaccctgggaacagctgtgccatg

SEQ ID NO: 7930 - DNA, 700 bp, Nannochloropsis_gaditana
tttctcctttgggcactgcatctgggctcacccaggaactgcctccaccaggaggcatggaaaaggcccgccttcgtcctgacaagaggaaggaggccggcgctggacgaagattcttttgtaccgagagagaagacaattctccagatgtggccatccccagagaaagcccgaagggagagggacatcgataggtgtgataatcttggagtcggcggaaaagtgccgttgatgcccgtggagaccgcgagtgaggcgggaggagcaagagagggcgtagcatgatgatggtcctcgaaattagccacgaaagtcttttttctttgcctgcttgagaatggcagaaaaaagaaagagtaacagattcaaattaagaaacaaaggataaattacaacgccaagccacgattgaacaagttgcagtcgcagtgacctgcgtccttcgacgtctggaagcacaggctcagccgtttccgggcacgttgaagtttcttaacggctgccctactacacgccccagccccgttccgccctcccaacgaggccacggggcgaccggtgcacagcgcctttgacgacgaaagacgtcgatgctgctggattaatatgctgtcactttgttataggtgtgaaattctaacaaaacgcaccactcgcaggaatcggaggtgccaatgaagacaacgaagaacgcaccgaa

SEQ ID NO: 7931 - DNA, 700 bp, Nannochloropsis_gaditana
aagaaaattttatttttcagttgtttctcccaccgctatctttttaaaaggcacgcgtgaataagtttgtatacagtgcgttgcgacaaatgccccccctctacacgtttaggttccaagaaagcactttgacatggataacccgggggcttttaaaatttcaaataacggtttcctcggtttttgttcgcatcctccggcctccgccctctacctcttccctcactcgagtccctttcaggacgtggattgcgtccccggaatgtcgtcaatggttataatctttttttgagaatgataaatagatgcatcattttatttgttcgtgcggttttcatgaagcagttggtagatttttcttgagaaggcccgctcgactactgactgttccctggtcttcgacgtgacaaaccccgtgaatgatcccttgtgcacaagaccccgaccatggcctccccgaggatgcatgagcactttagttgcaccccccccccttaatgcacatcatagacactgatttaaagcacgattaagctcaggggaaaagtataaaccgcgcttgaaatatcgtgcagttgtatgggccgcggtctggattcatgccctgttcgcctcatccctctcgaagttctccgctgattgtttttgcgtcagtactcacaaaccatacataccttatgcctacaaatacattcgcagg

SEQ ID NO: 7932 - DNA, 700 bp, Nannochloropsis_gaditana; identical to SEQ ID NO: 5369

SEQ ID NO: 7933 - DNA, 700 bp, Nannochloropsis_gaditana
gaggggggccggtaggctgcggcccgtgcgaccgcttaagccctttttttaacttcgttcctgtggacagaatcagccacgaggcacgtcgatgggtagttgagagcgccttgggaaatttggcttttgttctctgcatagcctctgagcttaatgccttcactttgggtcatattgcattctttctagctccggacgttttcagggcgctttttattccagtttgctcgtgcacagagaccatttcttgcatcatgccgataattcaccatgcttttgccaagaattatgttattcatcggcgatctcatgaactcttttgtatgtctgacgtccaatgactcacgctttgcctaatagcaactctacaccaacctgttaacctcctcccctccctgtcctctctgttatttactattttgacaagactctgcgtgtccgcacggcatgctttgggcgttttaaaactaaccgttgtcggatcccgggattgttttttgtgctgggatgactctgcctaaacccaccttctggataggctgctctgcatgtagacaagtaaagggcaggtagtccccacatcttcgcgcaatttttaaaacagagcctctccttcgtatatgactgatgcgtcgttttttcttctcgccttcatgcttagtccttgcttggaatcgtaggttcttgaacctcaatcatg

SEQ ID NO: 7934 - DNA, 700 bp, Nannochloropsis_gaditana; identical to SEQ ID NO: 4812

SEQ ID NO: 7935 - DNA, 700 bp, Nannochloropsis_gaditana
atctgcgaatggcgtagggctaagagcaatggtaggacttgcatgatgtcgtcgggaagaaaccgaagccgagggcggcgtcataccatcgaaattcgagatatcatgtggtgaatcatatttgtaccggattgattgatttgaagacatctctatattgaccaactcctgtttgggggggggtgaggccgaccagtctcgcgtttcatggcgcctgctcactcttttcattttgtctacaaggtgctcttacaaatgtgcctatcgcccagaatgaaaattaaaattaatattatcgatagagggcaaaaaatacgcacaaaacttggcacaaagggggcatattattccaaaaggcttttccaactagcttttaaattggaaatagaagatcgagcgtaacggctggaaaagatcggcgagacgcgcagacaaaccatgggcgtgagacgcgcgacttacgcgaccagggcgtgcacaggcttgcttcttgggaagctgcgtcaatgataggagggaattgcctgtgctttgtctctcggccagagatactgacagcgcatacttacgttggtctagcgtggatacagcgatgatcatgtcagggcgcagaattctcattaacatgcgatcaattgtcttgattcgaacaggtcacatccctcagcgaatactcgggtgcagccgataagtcatcatg

SEQ ID NO: 7936 - DNA, 700 bp, Nannochloropsis_gaditana
  misc_feature (1)..(237): n is a, c, g, or t
  misc_feature (672)..(681): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggggggatggaggtggagtgtgtgatagagcggtcgagactatgactcagacatgaaaaggtacgaacgggatcggagaaagtccaaattaacagcttgcgatacttagtacgtcaatggttgaaagaaaaagacagccccgaaaaaggaaaatcagcttgatcacggggcgcgggggccaaaaagacgaggcatttttattttaaaacccatgccagggcccgatattgggggcgtcccgtgtccacctcgttcagtcatttttgtgccttaaatcgtcgattgaatcatccaaatacgatctcccagccagagagctcccacaaaacgcgccccctctccctcttccctccctcccttcctccccccttgcctcccttcaaaatttgtagtctactcacaagtgaagaatgctcctggcaagcacgtnnnnnnnnnntcaagccgaccccagtatg

SEQ ID NO: 7937 - DNA, 700 bp, Nannochloropsis_gaditana
ctcccctcctccctacctattcttgccttgtctggaattcgtcaccgtatggttgtacagcttttttgtacggcgtgtgttgtccgtgttgatggtttgcatcactgaaggtcactcacgccctctcccccgcgcctcctgttccttgcattttccgccgtagcctcaacaaatacatctggaagcaaggcatccggaacgttccctaccgagtgcgagtcaagctggctcggcggcgcaatgaggatgaggaggccgctgagaaggtaggcattgagggggtttggaaagggagggaggcatggagggtagaaggggagttcgtgcattcttagtgaaggaccaatcacccacgcgccattttttggaaacaatgtctcacttccttattcccctttggcttataccatggttgtagctctacacgctggtgacccttgtagaggtggacagcttcaaggggctgcagaatacctcggtggatgagtaggacggttttgagcacaaaaagggggtggggagtaggggggggcatagggaaatgctgaaggaggtcgtccagactctctgcgtgcgagatttcctcctggagcgccgggcaagacggggagaagggagggaggagaaggtcgacgtccttgagtaggagaaaagaaaatcaaggcttcacggttcccggctcgaacctggcgcgtgatcc

SEQ ID NO: 7938 - DNA, 700 bp, Nannochloropsis_gaditana
ttgtatgatgttttaggtacccataggagcggtgccaggccaataaatcgggaccatgacgtggattccgtactcggtctgccggttttcactgtctgcaacacgaaaaataatcagggatccgaatgaaaattggtggaaagccaggagcctcatcgtgtcatatttttattcttgcccgtcgagatggtaatttgtgctggtggctgatgatgatgatcgatatgatggtttgggtaccctcgctgcaagtaacgcgtggccaccattcctcccccttgcctccccgactttctcgccttgttttgcttctccgtggtgtgagcacgttgctgctgttgaaatgtcgtggctttatgcgattggagattgcatgaacgtgcgaaatgcgcaagactctggtgtgtcgtgggattggaaggggtggctttggtgtccctcgaacgctgcccgacagagaacgaagaagggatgggaagaaatgtgcaaaaaatgtcccattgaagctcagcatcgtgtgtataatgtttgagatgttaaattttggcatttcagtcataatggtgccctttgattgtgccgggaaatatattattttctgccccctggcagcccgcccatcgtccactcctcgctcttaaacctgcttcttatcccactcacaagccgcattatttccttcatcaccgtagaaacgatg

SEQ ID NO: 7939 - DNA, 700 bp, Nannochloropsis_gaditana
ggaaggaaaaggacgggcgcggagaaggaaagcggaggaggtggggaggataatggagtgcatgcaaagtatggcgatggccgtggtggaaaaatagagccgggacagcgtcatcatgtgggttttggaaaaacgaagagggaagctggatgagcgggcaggaaagaaataacagggaaatagtgagcgactcaggcacatgctccaccgtgtgaaagacagtgcaagagcaccgtatcatatcacgtgcatgcaagcgcggagggtaacgcaaagtcagaattgctcacagcattgtgcttctggaagggaggggggaggttcacaaggattcaggcacgagactgcttaccgctttccataccacgctccgcaaaggggctattcacgcggctgctgcgacggacgtgtgatagatgggtttcgaggtatatgtgtgagcgcaattatatgaccgaatttgccggcggggatgatggaagtgagggagcaagaggaaatatgtcccgtccacagtctttcacttgagcacgcctcttgcctcctgtgcttatctcctgctgtacaacctcgccagctcaattaagtcttcgaaatttagatagaaaaaatataggtgtcgagcgcgaacctcccattaagtcaagctaatgtgtcatgctacttttattcctatcccctgtcagcgcaggccaaaatg

SEQ ID NO: 7940 - DNA, 700 bp, Nannochloropsis_gaditana
tttgttgtatcatattttcaaatccaatgttcatgccataattttatgggaggaatgtcaaggggcggatcaaggtggcgacgatgaggaagaattgtaaagacttcttataacaaagcaggaagattgttgcatgtttgtatccatgaagaaaatcgaccaggaaattattagacaacttgaggggcgacgacgtgaagtttccgaagttgatgttattcagccgacttgcgaagaagaatccataaagtaccttggttatgagaagtacatacgtttaaatttgaagttatcgggacttaaacacaggttttatgagaaaggtaaaaagagactcggacaggtctcttaggggggtcggaagctttcctcgtgagatgtggctcgtggagaagggacaaaatataacaagcaacaggccatatccctcgctggcttcttgccagaccccggcatccgctgctatatgactcttgtccgatttttcaaaaccaggtgctttcgtgcgtgtttgcatcgcagtgttcgtccgacacaccgccctgcttattgcccgtcatcgctaaaatttgctgttatcaagttccttggagaaaagtactttgcctcttaccctaccctttttcagtttccaaagtcctgcttgcggctcgctttgtaatggtacgctctcactccgtgttgcacatgttgctaggtg

SEQ ID NO: 7941 - DNA, 85 bp, Nannochloropsis_gaditana
aacgatgacgtcttcatgatcaagctggactccagcggcagccctgtgtgcttccctccctccctccctgctgttggcaggcatg

SEQ ID NO: 7942 - DNA, 700 bp, Nannochloropsis_gaditana
ttttgcgaaaatacaaggggcgagaatccacgatgatcaggaatttggaaaaccgctatcgccggaaatggcagtgtccttgaaaagaagcgcggagaagcagacaaataggggtgggaagggaagaaaacagagcggcgagaaatgtgtgttttctctttcttctccaacttcttctttcttgtttgtacacaaattcaaatctgctggacgaatgtgtgggctttggaacataagacatgacgggctgcaagagagcgcagtttaggatttgagcaatcattaaattcgaagagcagaaaactcaatcatggtccggcatttatgcatcgggatagattgctttctacctgcgtttagcatcgcgtttgagatctgacagagaaaacaagtgcgatcttgctaatgggaatttcagtcatatttcaagtatttgttggcaacctgctttcttgatccagccactcctttgccgaccagccactgcgtaaaccttttcttatcgaaaggatttctcagagtaatcgcagcttagtcttcagtactttaatgtgtcttttgtaagctggatcggcccatgacaaaaaacttcaacctcctcccactgctgttcctgacccgatgcttatgtgggtagggtgcaccattacccgtcgtggttctaatgttcccgaaaccacaaaaaaaagataatataatg

SEQ ID NO: 7943 - DNA, 700 bp, Nannochloropsis_gaditana
taaataaacacacggtcaagtccgcccatgaagcgccttcagtatgatatcagcaacgtatgtgcaccttacagcttgattgatgctggtggatctcatttgaatcgcggtctaatgcttattctacattgtagcctggaggcccttcggctaactaccaggagcatattctgccagttgtaagacttacctgtaaaacaagcgcgcgagggcgtgcaaaaggtcacgatgcacgtctgaccacccgatactctactctagaaagactgtgccgcactaactgaaacaaaaacaacacataagtatgactttaagaaaggcggaaaataaatggcaagttgaagcctcgacgcgcgagactgctgcaaccatcccatcttgccctgcaagaaaagaaccactctccaagcacaacctggactgacgagcagttcttcatcatcatttctatcaagacgtagtgttgaatgctgcggaaagtcgatttagtggtcaagagcaaatgtttaaccaaagatgcatggcttagtgccccactgaacacgacccccaacatgtcgcacaggtcatcttaccccaaatcctttgggttcggaaggccacgataccttcgcaccaccaccttacggagggggtttggcaaagtctcacttttctactggacttactatccatcccctcacagccggcgtaaaccatg

SEQ ID NO: 7944 - DNA, 700 bp, Nannochloropsis_gaditana
aggcccgaccatccccttccctcctcgcttgttccagccctctcgactcgctgctttaactcgaagcctgcgtccactgcagacagagaaggatcattcattaccttagcgacccttaccttgacaatgagcgcataagttctgtagtaaaatcgtgcggaaggaggggaaatgtcaaagaacactctggtcctcatggcttgtgatatccactgcttgagcctcttgagctattgttacaagccttccgtccaaaaagaatagacctcattcaatgatgtcttgaaagtctggattgtgcatggttttcccccccgcacatctacatattcttggcgcataaaccttctcagaaggaacaggggcccttgaagtactagaacgtcgcttttgggcgaggctaagtgacaagtctccgccttgggtaaatcgacaggcgtttgtcgtgtgccgcaacaagtaatgccaaagcatgtcctactacgtagaagatctacctcgctggtttctcaattgcacctggtttgcatctggctcatacacaatgcattttttcttgtgtcgaagcgtcaacctccccgttcctcctctctggccttactttaacttataacactccattctgcccagcatgttttccactgtttcctcatgcaggatgtcaggatgggctgtagcaattattttgcttccaacttac

SEQ ID NO: 7945 - DNA, 700 bp, Nannochloropsis_gaditana
cgaacacaatattccaatcagcaattgattgcccttgttgcgatcaccacatttaaatttcttcttgtctgcatgcctgtccaaggaaggcggtgagtatgactggcagagatcctagtattccataagagtcgaaggaatggtgcgggtggctgaaaaataacagtagatgtgtttttgcgaggccatactagaaggttgagacatctttgatttcacttctttttacgatggccatttccatcgtgtactgctccttgccactcccagcgtacatactcctgaccaggggcgtgaaacaagatcatactgctttcatgtaacaaccgtatcgatatctgtgggaaactgttcatttttctttttaaatgattacattctttcattaaaatcgccgctctttccatcgccatggacagcgggtcatgttgcggcgactggaggcgaggaggactgtactcggagtgctttggtgcttttttcttgcggtgtctgttggcacgttgctcggacactcctctcgaggatttgtggatggtgccgcttttcggagaggtaaaacgtacagtgtacgaaggagcttctcaagcgccccacaaaagtaaagtatggagagacgcatcaacccaaccctaccgtgtccttttcgtactccaccgccacatctgccaaatcctccgctcctaataggatcaccatg

SEQ ID NO: 7946 - DNA, 700 bp, Nannochloropsis_gaditana
tcctttgatccattgcttccaggcatgggccgttgtcgcctgaagagcaaaagaacttttctcaagagctgaaaggacaaccaatgcaggtgtgaacacacggtaccgtggaaatgagacagaagatcaaagatgactgcataaaacctaggtcagccaaaatatcggattcatccgagccgataaatgcaacatggattggctcgacagccaattcttcatgggggaggttaccgtgttgcaagccgcagctagcagaacctgcggattttcacaccactcccacagccttgtgccttatgcaccatgttaacactgcgcctcattcctaacactcttagtcacagatctgttcgtgcgatcacgagtggtacaccgcatggccgcgagacccgcatgctaaacctcccgccgccctgagttctgcagcgttgtgacccgatcctgttttcccacggccatgcctaatttcaacatggtacgcgagcctacggatggcatttcaactaggcatgggatggctttgctgtttttattgacgacggccgtagctgctgcgggcggcgcgggagtcgtcctgcttctacagcagcgaggggccctttcctccccccatcccctccctcccccttcaccgcacaaaaaagatcgagggaaaaagcaccatacgcccgtgggaagtccaagcaaaagcaatatg

SEQ ID NO: 7947 - DNA, 700 bp, Nannochloropsis_gaditana
  misc_feature (609)..(658): n is a, c, g, or t
agagatatcttcttcgtctcttctccctctaaattccctccatagccatcagcttatgatcacaccgcggccatcgctttccgtcgccgtcctcctcctgttgctcctccctctcctcctccccaccgtcctcctgggcgcttctaccgataaaccccagggacataacggtcttgtcaagcctttcaagcctggaccgccgagcatccgcctcaagaaaaccgaggtcgagaaacttcgaaaaggcgaggccgtgaaacagcagctgtcctccggatcgggggggcggggcctggtgattcaagacgtagaagcccctcccgaggttgtctggggcagaatcatggacttccctgcctacacccgcatggttccacgcgtcagtctctgtgagaattacagggttcaagagaattacctgcagggcctgaaggagatattcacccggatgcgcctgactgtgatgggcttcaatgtcgagtatttcatccaccataaatatttcccgaaattgaacacggtggtgtggacgcttgactacaaccgagaggtgtgcactcttgatctttgcctccctctccttttgtgcttcccccttgagccggaaannnnnnnnnnnnnnnnnnnnnnnnnnnnnnnnnnnnnnnnnnnnnnnnnncccccatgctcatcactcccctgtcccccgcgggcaggcatt

SEQ ID NO: 7948 - DNA, 700 bp, Nannochloropsis_gaditana
atgtactaccaatatattgaatccacttatgaacgcgtctaggggcaaaacagtcgggtaaaatggcattgacgagcacgaaacagaaattatgtcagatcttaaccacgcaatgcacgtatgtcagcatgatcttcacgcttgcaattctggttcacgtcaacgacatcgatatcgcggaaatttctgcctgccgcaaggatggtccccacaggttggacccaagccttcgcgtgaaatgagcagagaaaaactttcaattatctggctcagaggttgggataagacgcgaacgtctccgcctggctcgttttttgttgcttttgcacaggcatggaaggtttttgactgcccgaggatagggatgatttggggccatatgctgcgtctgcatggagagcaaccaatgtttttacaatttcgacgcatcggaggcaaataaaataattatgattccatgagagcttaagtttttgcgctatcgtataacctttcaccagcataagcgtgcttttacagggaaatttcccctctcatgctttgcttggagcatcttttcgttttttgcccatgatgctgggtagtgtatcaacccctcgcgcatcacccctgcgaaaataccacaataaacagctctatcgctgcttctatccagtcgaaaagcaagtacagttaaattttacccggtgtcgagtccatg

SEQ ID NO: 7949 - DNA, 700 bp, Nannochloropsis_gaditana
ctttccgagcgtgccacatccatccacaaagtggcggccggctgacattcttgaaaagcgatgcgggaagaggtagacctgtgggattttttttcccagtgccttttttggagcccaagcgggtatgagagcactattctagagtgtgtcgtgggaaattgacggtagcaccaaggtcgacaggcattgcgatggcgaacccgttcctagaagaaagcgaagcaaatggagaaatatatcgtcaaaggctgcccgtaaaatttccaaaacaagattaagcgacgataagattaatcatttaatacatcaatagaattccgctaatttagttgacggacacgatttccttttatttattttttcccccatgctcatcacttccacttgaagtttgagccctacgtcaagttgtagttctcgctaccttttccttctcccatccgcttgccatgtcctaaatttttccagtacccgaacacgtatagctgtcctcaccaccttcccttaatctgttggtgacatgcacagccccatgcagaaaagttggctgagcatcgccttggtcttggcgtgcatgacaacgccgagtgccttcctactggcgcctcccaccactcatctagtaaaacactatcaaggcagcactcgcctttctgcctccatttatgaagatgtcaacactgccgtcaaacaagccatg

SEQ ID NO: 7950 - DNA, 700 bp, Nannochloropsis_gaditana; identical to SEQ ID NO: 4452

SEQ ID NO: 7951 - DNA, 700 bp, Nannochloropsis_gaditana; identical to SEQ ID NO: 4450

SEQ ID NO: 7952 - DNA, 73 bp, Nannochloropsis_gaditana
cgcggacccccctgccgcaccccctgctcacccgccctcccaagctgacgacaacgtcccccctcacagattc

SEQ ID NO: 7953 - DNA, 65 bp, Nannochloropsis_gaditana
gaacgcatattgtggaagactggaggcagcgtgcgacggaggcagaggaagcgcttgtgaagatg

SEQ ID NO: 7954 - DNA, 700 bp, Nannochloropsis_gaditana
aaacgaccacatgtgatagaaaggtacatggatggccccctggtattggggagagagtcgtatgaatgctgggaaccgcattttttccctgttgctttcatagggaaacgcggttttcctgtctcccggagagtccaatatatttttttctcttgaaaggccatttgtaagtatcctttccccctccgtgctaagcggcgtgcccctagataatcttgggggttcttgcaggcctcgtgactcgttggtgaggtctcttgtccgagtttgtaaagtgtggcttggaggcgcttgtcgctgccctgtcgccaagaaggaatttgaagctccccatggtcgttccaccgaatgaaagggcgagggaaaacgtggataatttccctccctcatcaacggcacttcgagaagacatgcacaaacattacatttgtcgcaaagattcgtgtctgtgcgaaactgtctttctgaggggctgcttcgcggcgctcgacggcgagggagagccttttctttgtcggctctgatctgtctcgtttaaagtcgctctcgtgccatttttaatcacggcataattatttgtccgcattctggaggatttaattactgaggcacaattttgtcatgctcacatctccgttttcatgttacttgatgttgctcttcagaaacgccggcttccataccaggcagggcaggcatg

SEQ ID NO: 7955 - DNA, 700 bp, Nannochloropsis_gaditana
cgcttgggtagtatgattaatagaaataggtgacccgaggacaaagaaatcacggtactgtcaggaagaagaagcgatgacattgtcgtgatgatcatgcgtaaaataaacatggaatgttccctgtatggccttaaaggagaagcaggtaagtgtgctaacgcgccatgggcccgaggcctctcattcgaatgccaccttcggaagtggactctgtttgaggcacatttaaagtaacacctcccttggtagcactgagtcaggccaaacgctccaatttctccacgccaatagcagaccgattgccgatgcacccgatggactcttgatggtgccaaatttcaggcaagcaaagcgaccgcgggcgaagaagggcgaaggcgacactttctttacagcccccgccaaaaatgttggtcaaatcggaccacagacacacatcctcgtgtcgtgcagacataaagataatgttgtggagttcaatgccatcgatcgaaaatatgcccccaaggattttagggctgggagacgattttttgttaactttcactttttcaagtgcaacttgttctttgttggcgccataagtccttacgtctcgaatgacacctaatttccgtgatggatcccatgcatccaacctaccaactccacagcggcaaataagcccgttttaaacacacagtttgaaaggagcatg

SEQ ID NO: 7956 - DNA, 700 bp, Nannochloropsis_gaditana
  misc_feature (95)..(261): n is a, c, g, or t
atcgaggtctccgtcatctgcctccccgatccctccccggactggcccggcccctttccgccggaggcggcgcatgtcccatttttttaggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtcagggcagtaattacgagggggctgtcgcaggcatgtggtacggcaccagactttaacctcccccctatgaaaagggagaggcagtttgtccatgtatttttgctaagcccttacgtgtagtgggcccaacatatgaccgcgcattttttcaatagtacagcaaaaagtacaacgtggcgagtgacaggcggttgcgatcatcaagcacatttggcttgaaagaatattgttcgccttagaaaccgcctctacaaaaggctccactttatgaataagaataaattaaatagcgcattttacctctatacatccccaatgagaaaacaaatgatctccaacgaggaaaaaaatgagaatttaagtaagctttgagaagcctgaggtaatgtagcagttccagacatttcatttcaatcttaaagactctacaatcc

SEQ ID NO: 7957 - DNA, 700 bp, Nannochloropsis_gaditana
gtgcagctgctatactgttgttcctctaggacccgccgcgtcgtatcacagaggcgcgggactcgtaggttgcttgcgagaagaggtgtcgagaaagataccttcctgctacatgcgcatgcggtctggatactgcaccacgtgtcgcaggctccccgacgactccatgcatggtagggagcatgctctgcgcgacgaatatctcaaagtatccaatcctgccctgacgatgtcaccagtgtcctcggagaggcattccaagccacaaagctgccatggtgccgcgaacgcctactaaactgggaacggttacgaaaagctatgacgtcatcttttctttttttcattttcgcacggtgttcttatcggcatcacaagatggggaggaaaattattttaccgcaaatatgtcccatgggcagctttcatgtcggacaacaatggtgattgcaaaagtcgtggtctctttttgtggaaggtaactctgcgttgtgaatgccttaatgtaattattcaagtcgtcaacctcctcgtactactgctcaagacattggtcagaactcctggaaacgcccacgtgagggctaccgattctcgtttgctctacatattttctatttttgtgttaatatctacaaccctttcaaatgcagacgcattaatttcttccagcatgtggtgtgcttcttctaccgcaatc

SEQ ID NO: 7958 - DNA, 700 bp, Nannochloropsis_gaditana
  misc_feature (1)..(679): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttggcccgccgaggtggt

SEQ ID NO: 7959 - DNA, 700 bp, Nannochloropsis_gaditana; identical to SEQ ID NO: 5552

SEQ ID NO: 7960 - DNA, 700 bp, Nannochloropsis_gaditana; identical to SEQ ID NO: 5543

SEQ ID NO: 7961 - DNA, 700 bp, Nannochloropsis_gaditana; identical to SEQ ID NO: 5544

SEQ ID NO: 7962 - DNA, 700 bp, Nannochloropsis_gaditana; identical to SEQ ID NO: 5545

SEQ ID NO: 7963 - DNA, 700 bp, Nannochloropsis_gaditana
gtttcctccgctcccagcatgtgccccaagcgccggcggtaatttccaatccatacggccgccccacctgtagccatatgagggtcaagagggaggcgtgggacatggcaaagtgtcaagtcatggatagccgggcacgtgcggaaaaacgtggacgggaaaaggagaggaggaaagcaacagacggcgatgtcaggcacaatatacaaggcacgcaggacgctccaaacactcgcatgcgatcatttgggtgcatcatgcttggtgtctacgcggagctatgcgtacgtgaggtcggtgtgccggtcaagttcgaacggaagctagattcttggcttattggcttagcccatcacgaaacgaagtggccgggggatcgtcacctaaaaggtcattcgagaaaaatggaccgatgtggactccatgggcagcgaaaagctcgtttctgccatcttaatacaaaggagcacaatacttcatctggtgcctgaaagtggatagcttatccatgaaagggaaggaatgttgctggctttgcttacgtccttgggtgtcctcgacaaccctcattagaccaccctttttcatctcacttatcgatgatcccgcacaggttaagcttttcccttggattgtcctttacttgcaagcacactgaccgtgatcctgcctcagcgcgatactttgagcggtggccatg

SEQ ID NO: 7964 - DNA, 700 bp, Nannochloropsis_gaditana; identical to SEQ ID NO: 5499

SEQ ID NO: 7965 - DNA, 700 bp, Nannochloropsis_gaditana
acttgacaaagagaaaggtgatttcaagtgcgcgttcgtcgacgacattcctcggtgtttggggtcgggataacagaaaagtgcttatgggaggagcgcatcgtgtgggggagggcgaggacgatgggatggcaagctctcactttccagtttataaaaggcacccgggccggcaccgatcctttttctgaacgagaaacagtgtttcaaatgcgtggtgaatgcgggttgggttttgggtttgagaggatccgttgcatggccttatgtgccattttttttatctttcccctgtaaccctccttcctgcttgagctgtctcgagcgatttgattaaaccacctcgcaggataatcgtacgcacacctatggcttgcgcgtagcagtgtctgcatgcccgtggctgctcatggacactcagacctgagggttctgtccgtctttgtggcgtgtgtaggcctcatgtatttgtacccatggtgtgacggttatttgctcgttgtgtaggaatgccgccaagggtgcgcgggccaaaaaatccatccgtagggacacgcgcactcctctttcgctgcatcagcgcgttcgaatgactccggtcctcctcgacccgcttataaccccccctttctgcctccccacctcccttcccctctcccctccttcctcctcctttcctcccggcccatcccagtccatg

SEQ ID NO: 7966 - DNA, 700 bp, Nannochloropsis_gaditana
acctgcactactgccagcccgtccccggggaaaaccctgcgatgtaagggcacgactgaaacatgcatgcacacaaggtgtggcctaatacggctccggcggtcgactccgtggtactcgcgccgttaacctccgtgaagagggagcgagctgccctccctccctcctcctccctcaagcctttccggccaaaccaccatgcccaaatccacctgtttccttccgtccgacccgaaaatgcatggatgacaccacgaagaggtgcgcatcctttcccatgcacccaggcgtggtgtcgcatcgcagtggtcgtgtctacacggcgacttgtgttgaggatgacatcacgaccctcccatcttgaaaggttctgtcgccccggcggcaggactctccaaaagacataagggccgtatttatcggcctcctgcacacatgctggttgcgaaagccaccaatttttattcaactgtcagacctgtcattctgtttgcacgccagacaccggaattctcggactcctgactgagaaaggggacattcacaaggccggcgcggccggaaacctcccctgatcctcgtatcgtacactttacgcgttcattgcaagcatttacaaatgtcgccccgtcataatgtcatactaaatattttaggtgtaggaagaggtggataaggcacgtatacgtcattccgtatg

SEQ ID NO: 7967 - DNA, 700 bp, Nannochloropsis_gaditana
tatgccgtccaaatcttaagcacttcagcgtgaactcgtacaggaagcattcacaagagcaagagagtaagggagggagggaggcagggagggaggtagggaggaagcggaggaatgacggtgtcgacgacaatcaggaggaatccctgttgtattggtacgacaagagcccttcccgcgttcgttgagtagtaccagactctcatttcctttcgaaatggtaatattatcatgtgttgtgccgtatgaaggggggtaggcgggtccgaggaggcgaacttcaagggagggagagagggaggtctgtggtagtccgaaatgcgatcgataaaccacacaaaaaaagccacttgccccaggtatcgcccgtctaaaaggtatggcatgtcactcatattacaaggtcttggacgctgattttgcccaaccctcattggttgcaaagtgcaatattatcgtttaagacgagtctcggttgaagcaccgagaaagtttctcgtttgtccagacttttactaaatgtgctttattgtcacggaatatttcttctcacgttgtgcaatattttcaaaccttcacactttcggccacgaaattttggcaccatgcgagtaagctttcagtattgcgttgtttaagtcttccgacaactccttacaggcacagactcgcttgctctattgctacacgatttgtgatg

SEQ ID NO: 7968 - DNA, 700 bp, Nannochloropsis_gaditana
tttcgggactttctacttaccgaggacgcccaggcctgtaccgatcatggcctcgcggataagaacttttacagcagacatattgtaggcgacttagcgtctgtagtatgagaaggacggcattcggattgagaatgattgcgctagtttaccggcactggctagatgtatgcttgggattcatgcatcccggctgcgcgtccacggacaatgcatcaaccatgccctctagccgctatatctcccttaaaagcaaaaccgacaatgcgcgttcgacgtaggcgtgcgggtcctggccgcgcgtaagaacgctttcctgttggaaagggagacgcgagcagcccgcccctccgccctgccctgcctcgtcccggtcctcgtctcggtccacaagacccgcgacctccccccgcccttccccgtgccagccagccgcaaacaccaaaaccttgaaagaaaaggtggaaggcaaggaggacatgtctgactgttctggaatcatcatccttttccccatgcacgggcaggtgccaggtatcaaattgtgattagcatgaataactacctcctgcccctggtcctggccttcctctgccactatagcttcgccttcatcaagcccttcgcaccgaaaagtcggtcccaacgtttgacatctcttcaacctgatggaaatgctcattttcggagatcgaggatg

SEQ ID NO: 7969 - DNA, 700 bp, Nannochloropsis_gaditana
ccttctttttcctatacacacagcgggatctagcacaagcaaggctggcccttgccaatatggaggccgaaaaagacgacctagaggtgcaggtgttgaacatgcgacagacatcgaagtagagcataaagtagaagccagcattgacagctcgtttgtctgaaataaaatgcattgacgggatgtgaggcggtgaattctttgaagggggggcgcggttacgggaatggggaggttactcgactgtgttattttggcatagttcaaaattgtaacatcaatcacaaacgctacgtgcataggaaaactattgctttcctattttttcccctttgatagtcaattttcctcggatgtttttgacacagcttcctcatgatttgcaaacagagatcgctaacttgggaggggggaaaagagaggagtcgccccccccttgtcagcaagttccattccatttctcgtcgctgtgttttaaattaacatccaaagatgccatcgcatgaaagattaagattttgttactgagcttatgcttagtgctgtcgtggtgtacagaggatcacggcggtctgccgtcgataaagtcggtaaaccccttctctctcacccacttcatttcctaatacatttcttccttgcctccacatgcagggcgagcatcgcgtgccttgtactctatcgaatttggtaaaggatg

SEQ ID NO: 7970 - DNA, 700 bp, Nannochloropsis_gaditana
tcgaacgcacgtacctgatctgattccatttgtcttgaaagtaaagacggaagtgggaatgcggcacgttgaatcacgcaaaagtcttataatgtgcctgtggtcgtattcggagtatatgttcgtgtttgcgcgggcttatggtcaggatacaagctaagtgagcgccaacagcaagcaattagggaatagcgggacaagacgacgggcggagaaacacaggggcagacggaaataagtgaggaccgtgaattctcttgagtgcttgcgtgaaataagacatataacgtcactcgtcgggtcgtttcgcactgtgcttccagacggccttgattttcaagtgtggcgttgtgggtttaattattgcgggcaactcgtgttctcttgccgcccgcctctgcctcacagccgtcatcagatcggccgcagcccgaagcctgtttcacccgtctacctctgaaggcatggatgcccaaacaacgaaacttttatagccttcacttaacgttacattcatttctcattgaatgcatagaccggaaggcgcgctttaaatgcctgtgcgcttcattcagcggctggtcaacagctcttcgtccttgacagagaccagcgggcggcatagttgcgggcgtgcgactcgccacactacccagtctgcccccagtcgtctatagtagcactacatcccgtattcatg

SEQ ID NO: 7971 - DNA, 700 bp, Nannochloropsis_gaditana
tctgatgtctggctttcctcccaaaacactgtttggtgacaatcatgaccggccattgggtgttttgctgcaaccaaacgaggtagtcacagttaaagaggatggaggcgaggagcctcgagtgctgcaaggtcatggtctgatgaaacaaaagagaggggtaaaggcaaagggcgcaagtggtccggcgaagaaagaaaattctcgacgtacagataaaaatacagtgagcaaggctgctcttgttgtgaacgcgggaccgaggattcgcacactgcaccgtcagagtggaaatggaacgggcggtcctggaactggcggtgaaaacgcaacacgcaaacgtcgacgcatggacgtgggcgtatcaaacgaggaagatttgggggagttgttgcttgcttctgttgggaaagggggtgggggcggaagggttggacgatgtatgcgcgcagtgtttcggaaagctgttgagaagaacttcgatgaggcgaaggccgcggctcgcgtggcagccgttcaaggagggcggtactcagcaaaagcaagcatagaagagcggcggttggatgggtcgtgcgcacgcctgcacgtactctaccacaagggccacggctttcaaagcgactatcgagatgacgttgagctcctttctcaatcgcagcttctgggggtggttcgctcggtcctggccgacgtggac

SEQ ID NO: 7972 - DNA, 700 bp, Nannochloropsis_gaditana
ccttgaagaagacggatgggtggcggtgcaggcgttggtgagacggaaggagtctaacgtcaaaatggaccagctccacgacgcaggcgccacggatatccttctttttcccatatccaattctcgcatgtgagaagtaagcgcaagagggcgggtgctacattcaaaaaataataaagtaaccacgcttttaaaaaatcgtccgagcactcgtgatttttgggtttatgcattcgctgccctgctcgcgcattatttctaatgagacttacgagcaacagggatagagaggatgaggcttacatcgagcatcacacttcagtcttcctttcattgttggtgtttacgaaagtgattttcccttatccttaggaagggtacccggaaatatcaagggacttgcccacctctggcccacatgtagctttggggcttccccaagacttggcatatttatcagaccgtgataaatgaggtcacaattttacctcaaggctagggctcctgttccacgaaatgcgaggtttttattcggattgcaatctgcctaatacagaacgggtttggacacttcaactaagcccctcgcgacttctcatgccagtctcacaattgtcgttgcttacgcttttattccgcaaacacaaaattaacctgcagactcatactctatgcttctgaataaggtatacagcagatg

SEQ ID NO: 7973 - DNA, 700 bp, Nannochloropsis_gaditana
gacgtaggaggtagaatcgactccccacctgtaacattttcaggtccactttcctcaagtgtagatgagagtggagggaaaacagcactggcacccccagggctggtttccatctgaaatcggggaggtagacaagagacgacggaattcgcaatttgaacgatatcgtgcgactggacagattaagagggacgagcggcgcgaaagggcaagaatgtgagcaacacacagttgcacggccaatgctcttcacccccatggaagtgacgggagagcgcggccagggagaactgctgtcgagcgatatgatggtatcacgccctaccgctggcagccgatcgatcccgccgcgccgagccctccgtagtgtgccaatgcacacagggtttaaggccatcttttgtccagaatttttcatggacgtgaagctgatcatcttggcatgacctgctggtgctcctcgcccacggggcagtcctgacatccaggactcatccgagtggacacgatattgagatggccttccagcccctcaactcacgcccacctttatcgagctgctcatatttaagcagtttcctcccccttttacagacacacatagcccaaggatcgtctcttacacgaaagcacggccgactgccattaataattagatccgctttgcgctaagattgtgtacgaggaccattttgacatg

SEQ ID NO: 7974 - DNA, 700 bp, Nannochloropsis_gaditana
ggccccgatgggaaagaggaaggacccgcccgtactgctacgcccgaagtaatcgcggtaccagtgtaggatccggcccaggtgcagagagtcttcccggtccgaggacccgttcgtcccagcgctcaagggctcgctcgaggatgggggagagcccattggggcatgtcccggacggtgggccggttggtgcgtgtgcgcgtagtagtccggagtcacgggctggtactggaagaggttgtggaaacgtttgatgatctcgggatccagggggtctggctcctgcgcctgcttggaccccaccgatatcaacccctctttgagtacgccaccgtcaacctggaagacgtcgtggcaaagcgtgtcgaacaagtagtttgcgatcagacacatgggattcttgactgagcccggggccaagacagtgcccgcgtggctgaggcgtatcacggagtcgtgcaccgcgtcgaagatggccaggtccagcgagccttgcgctatatacttgtgcagtccaggatgcgtctcccagaagttgaaatggttcttggtgaagtccgtcatgacgtacacaattttctcgaagggaaaatccagcagctcccgcatctcttccagggctttgagcataaaaaagctgaattttccggagccagcgcccagctctataatatacaatggttctgaaggatccaatgcc

SEQ ID NO: 7975 - DNA, 700 bp, Nannochloropsis_gaditana
cggccgctgagcacgaaggccgagactttcaaagaggcgtcttcctggggattgtggagagcgaagcccccccggctgatgaagtagaggccgatggcgtggtagttgaccatgaccgagaaggatccgtggacagcgatgtgcgggtcgaccaggcctcggaactgctccgcctggttgctgcccttgtcgcccgaaatgaccaagcccctgtcattgctgaaggcgaggaggcgccggagggcgcggagggccccgatgggaaagaggaaggacccgcccgtactgctacgcccgaagtaatcgcggtaccagtgtaggatccggcccaggtgcagagagtcttcccggtccgaggacccgttcgtcccagcgctcaagggctcgctcgaggatgggggagagcccattggggcatgtcccggacggtgggccggttggtgcgtgtgcgcgtagtagtccggagtcacgggctggtactggaagaggttgtggaaacgtttgatgatctcgggatccagggggtctggctcctgcgcctgcttggaccccaccgatatcaacccctctttgagtacgccaccgtcaacctggaagacgtcgtggcaaagcgtgtcgaacaagtagtttgcgatcagacacatgggattcttgactgagcccggggccaagacagtgcccgcgtggctgaggcgtatca

SEQ ID NO: 7976 - DNA, 700 bp, Nannochloropsis_gaditana
gccagggagcgctcgaaatgctcaagcgcctgctggaggcggcccagagagtagtgacagaggcccatattgtggcaggtcacgtggtgctccccaatcgaggtggaggagaggctgtagaagcccaaggcccgttcgtattcccggattccgtagtagaatctgccgatctcgaaggcgatgtccttgtcccgatcgagcatgtagtggtgctcccacacccggggcacgcctcggcacaggtcgttccgcagcttctggccagcggtggggacttgattgaggatggtctcgcgaaacttgtagaagacgtccgggtcccagtcccctagcttcagaagggcgactatcgccttgagcgtggggttcggggagtcctccttcatgctcttctgcaggacgaagaaatcgttggggccgaactgatccacggcggtcgagaaggcggcgcgcaggcagggaaaggcccgcacccgcttctcgccctccgactccgcgttggggccggcccaggatgacggggaggtgtcgaggcaggaggtggtggtggtcacgggcgagtgagcttcagggggggaatcctctgacgggctttccggagggccggcgcggccgctgagcacgaaggccgagactttcaaagaggcgtcttcctggggattgtggagagcgaagcccccccggctgatgaagtagaggc

SEQ ID NO: 7977 - DNA, 700 bp, Nannochloropsis_gaditana
ccgcaccctcctcatgctccgcggccttcatgtcgcttgatgatcgcgttcgtaaacaagtcgatatgacaggcacagggcaatgcctggagagcaacgacagaagcgaccgcctcctgctctcgcatcaaaggacaggcatggtgcgagagagtagtcagggaaaagatggtttggtcaccgctgtttccagggcggatggtctacgcgtccagcgcctcggaaggcgttgggtttgacagacaaagctcgctaacgccaacgccgggaccctgctcgccgtccgagggccttgtacacatgttatcaagcagacgaccttgacgtggagtgaactcaatgttggagggaaaacaaatttcaacacgcgccaaagaggatacgaaccgcgcgcgccggcgtccgggaatgccggctttctctcacgttcgggcgtgcggccgctcttgtcccgttgactagccaggcaggcgaagggattggtgctgaaatgtcattgcctttggacagcaccccgttgcctttcatgatttattttggaaaccaattctttgggttggcacgagcgttcacagatccgttggtgtgcgccgtctagatttgcccttgttcgacccgcagtgtctttgtaagtgtgttagggctcattcgttccctctcccgtatgcctctttgctcgactcagaacagattaaacatg

SEQ ID NO: 7978 - DNA, 700 bp, Nannochloropsis_gaditana
ttcctctgtctctgtccctgcatggctgccacaaatatctgctttgctttcctttgtcttagctgatagttgctgcagaccttcgtcttcattttctaaactccgacacgcttcccactcgtactcttgcctgaaggacaaaacactcatgtcaagctcctcttcttcctcttttgcctcattttgactacgctgcgtcgattctggctgcgaaatacgggcacttgcgttcatacctggcgtgtgtggctaaacttgttcatgatcgaagcagacgggaaacggatataagagggcgattgctgagcactgcgagacacggctctgccagcgtccaagaaaaaactaccagagacactacgcataatctttccgagcccgtcacggtctgcacggatggaaatagaagagatgcacgtgcgtgtgctaatcatcgcgtttcactggggtcacatcgagggcttgcgtttttcactcctgctagccccatcccatcccaaacgaccttgtcccgatctcgcgctgacttgaatatggcatgcgccgtctctttcccacgcctgacctgcgtaaaaatctcccctcacacttcccaggctattggaacggcaggaaattgtcctcagcgttggattcttggccttatcatagtgacgaccaggctgggtgattactttgtgggaggagtcgcaccgacatg

SEQ ID NO: 7979 - DNA, 508 bp, Nannochloropsis_gaditana
  misc_feature (477)..(486): n is a, c, g, or t
cctccctctttccagacctccaccctcttcgttgtcaactacgtccacctgccttcggacagggagaacatcgcattcatcgagttcctccttcaagaggcgcgtcgcctccttcctgacttcgtgagcttcgactccctaccccttggtcccccctcctccctttccccctcctctcccgctccctggagggggcgttacctccctcttgccacaccttcacctccttccctccctccctcccgtcctccttccctccctgtcccccgccgtcccttagggccttgcggagagcgtttcccccggattgacggggctcggagccttcagtgtggacatcacggaaggcgtgaaggaggatgctgcgaggtagccatctcttgactctctttctctcccttcctccctccctccgtccctccttcttctcctttcttggcttctcacagccaccgccccccaggcctacttccatcnnnnnnnnnngctccactccttaccactcatg

SEQ ID NO: 7980 - DNA, 700 bp, Nannochloropsis_gaditana
  misc_feature (562)..(571): n is a, c, g, or t
gatatgatgcattgcctggaataatctcgtaattccatgtcttcccaatcgatctaacgcgtctctggcggcccccccccggaatgccggacgtggtcactgccacgacgtccgagagtgtccgtatgagctaccaacaagtccagtacccttcctgctggaaattgtgcatttggatgacaatgctgcattttttgagtggttccagaagcctatttttgatttaagagtatttaaccctcagtccctccacctccccttcccacaggcctcggatgccgctcactcatctcctttggcgtccgcggacagccataccttgcacgaaaatcatgacgtcctcgtccgtgttccacagcttgctcgacgccagtcgtacttgtctctgcgaccctttgcactatcaggtcgtccatgtcccagtccgtagcgtagcctcctggtggggcaaagggaacaaggaaggtgggggagagaatgggggagggggcactggcaagggggacaaaaaaaggaaggggggaggaggggagaaacctgatgcgagcgctccgggtggtgnnnnnnnnnnccccggccccagctcctccacccgctggaagtggacagcctggccactcacaccctctctatccggcaccaggacaccctccgttctctctccatcctccgcgaccttcgtcgcgcccaccccgggatg

SEQ ID NO: 7981 - DNA, 700 bp, Nannochloropsis_gaditana
gtcataatttcggatcactgccagagaggcctttgaacgctctgttctttgcttgcctacttccagggatgctacctcgacggcttgatgcgcgtggggggatggaattgtgatgtcaaagggctatgctcgtctcctgatgagaggttgtatcagacgaacgctgcttgtgctcttccgaattcagagtaagctgtattagatatgtcacaatcctgtgatatatgtcgaatgttatttaagcgtcagatttctgacaaatttccggggcggcaaggtgcttctttttcctatcctcataccttgtgagggggcaagacttcagtgtcagggaaaaaccagcgggaccccccagccatcttgataccggttatacacaccactctttctcccttgcacatgaaacagccgtaccatgttgtccacgcttcagaggcgttatatctcgcatgcccgcctcctccaaattcgccctttctcacgattttttacgtcgtctatctcctcttcattacctcccgctcgtgaggggggtacgtggttagcacccgtggcaatgtcttcatttttttgcaagcatttcgtctaatgatgtccaatcgacaaatgcttggatactatactacagaagttgtcatttttgacgtttcctgctcatttctttgcaattttccctcttttctgtattcctctttggaaa

SEQ ID NO: 7982 - DNA, 3 bp, Nannochloropsis_gaditana
gag

SEQ ID NO: 7983 - DNA, 700 bp, Nannochloropsis_gaditana; identical to SEQ ID NO: 4995

SEQ ID NO: 7984 - DNA, 700 bp, Nannochloropsis_gaditana; identical to SEQ ID NO: 4999

SEQ ID NO: 7985 - DNA, 700 bp, Nannochloropsis_gaditana; identical to SEQ ID NO: 5003

SEQ ID NO: 7986 - DNA, 700 bp, Nannochloropsis_gaditana
tccggcctaccccaaaaagcaatggcgttgccatgccagtctctttggacgtcacagcgacctccgtgcgcgccttcctttttgagaacactttggtgtccatccactgggccttcggtgtcgtctcctttcccccgccacccagggcgcaggaatgggagggagcggacacagactcccccagcggcgcgtacgttcgccgcgagacacacagacctagatagagcacggtcgtctcgaaggaatgcccctttcaagtcaaattgtgccctcgtggtttgcggcgttgggcaagctgaccatccctctcctttttgctcctgcccctgcacaggtactgtcgtctccaccccccccccctcccggcctatgcaaagcgttcaggagctccgggccaacttggccacatataaatctcaggccgaccaggtaggcatccggtgtgttttacagcacggtggaatctttgttgcctttcctggatgtgtgctcgcgacaggcgtgtagcttgtccctcttcctggcctggggcatggctctctttgcctctgccctttcccacgcggacaatggacttggcgaggcacagcctttctcagactttcctcggatccctcggtggcaggtccggagcttgctggccaccgaccccggcaacgcggcctacgagcagctggagagggacttgcaggcggccatg

SEQ ID NO: 7987 - DNA, 700 bp, Nannochloropsis_gaditana
tatcataagcaaattaaaaaagaggttgacaaaatatgtggatgtattaccagtttttgtcgcggaaatcgttgacccgattagatttgcgaatgtggtactcgaggttatcccctgatggccgtccaggaatttgttatgctacagccacaatgagccaagcaaaatgcatttctttgccaaaagacaggatgtactggttctgtgatagcaggtaactccacctcggggcctataatggcaggaatcgcgcctgtcgtacggcccgcgttcttctccaggcgagagtcacgtcatactcggtctgcggagtcaactcggaaattggggaaaaggttgacacctcttggttttgtctccataatcctttgtagtgtctaagtcacaaaaatgctttgatcctcccggtaaaagctccactttctcctccttctcgccggtaacgactctctcgcttcaacttccatgacattaagtcttgacacgtatcagcaagtggacgacagctttgatcctcgactcgagacactttgtatttcacctcaattttctaattgatggcttcctttgcccccttttcacagagaaacagcctggcaaatcgcatctcctcgctttcggagaaccttgccacggggttggaccgtgtcctgacccgtagacctttcccccgggaggctgtcgatttgacggctttatg

SEQ ID NO: 7988 - DNA, 700 bp, Nannochloropsis_gaditana
gcccactgagggagcgcgggttcagagagggcgaggccggcgtggagcgcccaagatgagaaagcgcgtcgctgggctttggagaagacttgcgggtctcgccgtctcgagttgacgttccaggacaggggaaggagtgcaagggcggtaagaaggccccgtccttgcgcgccttggctgtcaaaaaccccaacatggaacgtgtggtgcgcccctctttgtgcagcagccttggtgtagggagcaacacgataaaaaggcagggaagcgcgtttgcggcgcacttgccacgttcctggctttgcccatgttgctcctcaaggattgcacccaaaccccatgctcctggccctacctgcctccataccgatgccgccggccttcaaaggaactgcctggtgacgcagttgccggaggcttgcacaagctcggggggtagacagtgtgcaacagggtagactgtgcccatttcctcttgtctggaaaaagtatcctaggctgtccctcggaaactcaaaccctgtccgcatgacgctctaccgaaacgcgtctccattttcactgtctttctcgatacctagcacaggggtacgtcaaagtttccccaaaaccgtctgggtacgcggcgtgggaagacctactctatctccctccaggcctgccagtccgcccatagggctcgctctcccggaccacgatg

SEQ ID NO: 7989 - DNA, 700 bp, Nannochloropsis_gaditana
  misc_feature (1)..(265): n is a, c, g, or t
  misc_feature (517)..(526): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaggtgccctacgacccccacctccgcttcctcttcttcggggaggagatcagcatggcggcgcggctctggactcggggctgggatttcttcgcaccccccgaggcagtggtgtaccacttgtggagccgggcggggcggccctggttccgagaaacgcgcgaccccgacaaggagagagagcgccgagcctccttgcgacgggtgcggaggctgctggggacgcaggcgggaagcaaggtcgagggnnnnnnnnnncccccccccaaaagcagtgtcctggcccagacacaccaagtcacacgagtttgcgacatctgctgtcgactctcttgttgtgatcacaatatttgattctgctctgcgggtggctcaggcgccgccagtattcgtgggcttgatgagtacttgtgtggcgctggctggagtatg

SEQ ID NO: 7990 - DNA, 700 bp, Nannochloropsis_gaditana
cgtgcagagagcattcacctcggcggaatcgcccacagggagcgtcgacggccgaggcgggggagcgggcgaaaagaagaccggtagctagcgtgcttctttggctatgtcttggaacgaaggtagcgcgcacaaggcttgtgagcatgcacaatgcgagaagtacggaaactaagggccgtcgggaggagggcagcctgacgaggccggcggggcgcatgcacgggcctgggagggagggcgggagggcggagggagaacggatgacgggagatgaacggccgagagacagactttgccctctcgtgatcattgtgagtgatgcctgagggtgaccagacgcacgtcgacgaagaaaggtatcctaaatgcagcccgagtacctcccaccctaggagtgtagctaacctcctgcctgctgccgcggggacggtcgagagtctaatatgcctcttttttcatgacatgcagccgtttcacatcgacatttctcatcctgctaccctcgtttctcatctgcttcacacaggccatggctagcgtcttcctcggggatctggacgacgtgatcggcccctcccaggcctgcgtcaaccccatcttcgccaccgacacctccacgcccccctcccagcggagcgccgctcctgaaaatgaggacaaaggcagagcccaagtgacggtggaggcggcctggatg

SEQ ID NO: 7991 - DNA, 700 bp, Nannochloropsis_gaditana
  misc_feature (1)..(379): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggggggaggttaagcgagggccacgcacttgccagtctcgggcccatgggacccctccttttcctcgacgggtatatcaatgcctcgtccggactcggtgtacccagcccgtgggcattcacaaatgaaagacgtctcgccaatggtgctgagacctgttgcggccgtcaaaggcgcaccgggggcggttcttaaagcagggacaggcccagaccggggggaggctccggtttgggaggaaggaccgcgcctcttgtccggcacgcagcacgctgactctgacgcaccgacgctaccttttctcagcatccacatg

SEQ ID NO: 7992 - DNA, 700 bp, Nannochloropsis_gaditana
atccgagatgagttcctaaatgctctgctctggccttgatacgtgccacagcttccagtcgaaaaggttcctcttccacgtttattctttgatccttctcagatcccttttccttttttgtgatcgactttccgtatgcgttcattgtgaaaatatcacagaaattagagccaagatctagcatagcgttcaagtcataggttgcagcagacaaagaaatgatatcgccaattatatgcgcgagacaaaacatttaaaaaaatcgaaaaaaaaataccaataggctcggaaaaagtagaaaccgctgctttcgtgtacaaatcgctgcagtgtccacaatttagagcccgaattcatattgtcatgagaactagtattattactcaccgttaattgatctgggctgcgcggatgctcttgatttcccccattttccacttctctcagctcaccggacgcgacacaaacacaggactagcactcgcccgttggcggcgactcgggaggcacttgtgttcttttttcatccatagcgtttgggacgtcacccgtctcggcagtgtgcttgtctagatgaccctgaggctcaaataggagagcatacgaggtgtcgcggcccacagagccaccacatcgatcccctccttgaatatatttatcgcccacaatttattccttccccggtctttccaacacaatg

SEQ ID NO: 7993 - DNA, 700 bp, Nannochloropsis_gaditana
caccttaggaggctccatccccgttgacatgggcaggcggaggcagcgggagggggaggaactcgcagcatgtgaggatgaagacgctagaaggtgcgaggacgtgaaagcctggagggccagtaagcaacagggattatataaatgagcacacgtcatgctagccctcgtataactcgatactgtgcttcaaaacgaacctgtaggtggaagggcatgggtaggaggagtgccactaggaaagctgttgaccacagtggaaaaactctaaagctttttggtcctttaactttgaactccattccgctagaatctacagtggattcacgctcctcaatacacctgtcgtttggaaaaagcagttcaagaatggatgagacggcacaataagttgtcgttgatgcacatgcttgagtgtgacgccatcatttaatgctcgctcatgccttgttccaagcagtcccgacttttcaagatgcaaatatgacgatttaaatgtttcgtacctgactcgatgtactttcttacaggcaaaaaactagcagaagggaaaaataccgctcgatttgttggctcactactcacttgcggctcttcttctcgctctgattcgagcttgttttcatattcgtgccgtccaaaacacggggggcagcaatggaggagacttcgagacacgaagaagaacaattgaagaatg

SEQ ID NO: 7994 - DNA, 378 bp, Nannochloropsis_gaditana
ttgcaaggagggaggacgtggagaagaaaggagtgtgtactagcggactggcgggtggtctccagggggccataaagtacgcgttcgaagcaacatggcaatgtgtcggcattatgcatgaattgcgtcgtttctcgcttttctttaacaaaaatcttgccccctcatctcctcatttcggccaggaagtccccccacatcaaagagtccttcccgttcgcccattccctcaaccgcctctccatcagccttgccgtcaacactgcactcttgctccctggaggcagcagcttgtcccacaaccacacggcagtttcggattccaacggttcgtcggccgtaacggtcacggtcggaccgaggggggcgaggaacggg

SEQ ID NO: 7995 - DNA, 700 bp, Nannochloropsis_gaditana
tgctcttaacgagcgttaaagggcaaagttgatcgagtcatcggctgtagtgactatgctatactcttgtaacagcatgaatcaaacgtgttgtgaattcttaacttcattaaggaaaggtgagaatgaataacatggatcaataccatgcaggacaaacctatttcacagacaaagtccacttgtgactacgcatcttgtcgagcataacttcgttacccaatttgacgtggtttctcaaattccatatagtcctctctttcattatcgaagtgcctattatgtcgtaaaataagagagacatcttcaagttatgacactttgacaggaagtactgagacgcatagcatacaaatggcagacagtgaataagctccctgctcgtgacccgtctccccaaaggcgacccggatgtggaaccgacgcgagcagcccgccatccggtacctaaagcttttgtcgtgccgtaaagcttgtgatgagacaatatggtgggcagctgaacaccatttataagcctgaagtagtcactacgtggtgaaaagtgtactaattcaacgcctcggcgttcaaggtgcaatccaatccgtccaagataccaagtatttgcgaggaggttgttcctgctttccgaccacccaccatggccgccaccatttcctctccttacacatcccattccccaatcttgctccttagc

SEQ ID NO: 7996 - DNA, 700 bp, Nannochloropsis_gaditana; identical to SEQ ID NO: 5732

SEQ ID NO: 7997 - DNA, 700 bp, Nannochloropsis_gaditana
  misc_feature (536)..(545): n is a, c, g, or t
tcatgcgtgcatcttttcatggcaggaggagggctttaaaatgcgcatggtggacggcagcgcccgggagttctttcactcggtaccttacgccccacaagactatcctggtagatgggggagggggggtgggaaggcgagggcaaggagggcgggacgcagggagggaggaaggggggtggaggaaaggatgcacccaaggggaagtgttcgtctccgcgggcctcgtgcgcgccctcttcctccgtcgctctgtcttgttctctcctcaaacgcgtgaattgagcccatcggggggaatgcgtcctgcgcctcctctgccgctccaatatgttccctttctgtgcccattgcctcctgcttgtggcggttgccaccgttcgcttgccatactgctccccttaccccctcgccctctccctccccctcgaccctccgccctcagaccgcttcgtcacggacctcgtccacgccaccctccaagatggccggggctatgtggagggtctgaccaaggtagtctactcactctctcnnnnnnnnnncctcccctcctcctttgatccctttctcccctgtctcttcctgatattcgtttatttctaatttgtccgaggggttcatatcgtcgaccgactgattcgtacaccgttccctccctcccttcctccttcctaaggtgtgccgagtcctcttcatg

SEQ ID NO: 7998 - DNA, 700 bp, Nannochloropsis_gaditana; identical to SEQ ID NO: 6695

SEQ ID NO: 7999 - DNA, 700 bp, Nannochloropsis_gaditana
  misc_feature (494)..(503): n is a, c, g, or t
tgtcctcttcatctgcggtccctccctctcactttcctgcctttccccttcctccctctttccctcccttccgcctttctttccccctcccttccttccttccgcagacgctggcagtcggtgacgagtgtggatgtgatagaagacggacagatcctaggaggggcaaaaaagggcttgccagaacaggtatcatccttccctcccctcctccctccctctctccctccctgcttcccctttcatacttttaccaccctcaattttctcgatgcatttctaaaactcgtagcttcttcccctttcttcctttcttcccactagcccataaggcattaattaattccctctcgtacgggcatgctcataaaatgacgctttccctccccatctcccccctccatcagaccctcctccgttggcaagagagccctcgaaacgtcctcctcctcatgaaacgcggctcccacgacatccttcagagggtggcggannnnnnnnnnacgcggtacgcatccctgtcttcctcccttcctttcccccccccctggcccccttccccagccattgaaatggagaacgcgacgtccgagagcgttctacagtgcttcttcgtgtgcgtatgcttatctctgcttgctcacgggctgctgaccctttctttcaacctccccgcctccgcccggtcttggtaggatcc

SEQ ID NO: 8000 - DNA, 700 bp, Nannochloropsis_gaditana
ctgttacacaaattttgacgcttttctcattaacgccacgtctctgccacgtaccccctcctgaacccactggcatttcagaatcacatggtccatttggtcatgtccgaacctaaaatcataccgacacgtccaaccttctaatatgctatagacttgacgtgtgaaccagttgattgcttttttcccgggttgatttttaatatttcgggacactggtacccaaagatactatactgaaagatatcgcacgtggtgtcatcaacctcctgcaattgccatacctatttttgagcagctttggtagctgcatgacctcgagacagcttgctatgatcaatcatgttcattcatttcatttggcatgaagcggaagtgtgtgaaagtagtgtgactgccaggcccatctggcggctgttgccgacgtactgttctacagccgctgcaactcgttgacagtgtcgtgattgtcttcattcaacgactttccctgtgttctacttcgtcgtcacttcaatctcctttcctcctgcatcacttcacttgttcccggagatataaaagtgcacaaagttgagctcccaatggcagcactgtactcatgacttgtaacactagatcatgtttagcttcatgtctctgccctttgatcatacatcacacttatcgcaaacatagaacagcaccttccaaagatatg

SEQ ID NO: 8001 - DNA, 700 bp, Nannochloropsis_gaditana
ctttactaccatgtcctcctcctcgtcctcccccttgccctctccattctccacctccagtggaataagaacggacagggccaggtgactaggcccgcgatcacagagcccgctttcttatgatgctgtcatttctatctccctcaatatgaccgcaaaaattgtcagacacgaatcgctcccaatacttgtctagctcgagccgccacacatacatatatgcatccaaccctgcatttctgtttctgatcgtacctcggtggttaaattgacctccgcaagccgctgcctcgctctctactggcactcaccgtcaactccctcttccccttttttcccttttgcagtggaacaacggctggaacaacggcggatggaaccaggtaagccccacgtccacattcggcccctccctcgtcctttccttccctattccatcacatccccgcgtcatcgcgtgcgacttgtctccgtgtatccctcatgaaacacactttccttattgcattcgccagtgcctccgagaagctcctcccccagaccttgccttctcacgttctccctctcgattccccctcccctcctttctgttagtggaacaacgtcaaccgttggaactgggtctaagcgtgcgtgcatctgaagataccgccgactgttcaggcacctaactgtacaaaaaggatgattcacgcctatg

SEQ ID NO: 8002 - DNA, 700 bp, Nannochloropsis_gaditana
  misc_feature (1)..(625): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcatctatacaagaggcgttggagagtgggggagtgccggggggcaggaaggaagtagctaaacccccttatg

SEQ ID NO: 8003 - DNA, 700 bp, Nannochloropsis_gaditana; identical to SEQ ID NO: 5671

SEQ ID NO: 8004 - DNA, 700 bp, Nannochloropsis_gaditana; identical to SEQ ID NO: 5678

SEQ ID NO: 8005 - DNA, 700 bp, Nannochloropsis_gaditana
accatttttggccgtggaccttgctttaagctatcgactgttgttttcctaccccgcatcacagcgtcaagtatcacgaagtgcatgctaatcagcaccactccgatcaatgcctacgcctgctccgtccaccacgtcttcctctgtcactcctccgcatcaagacatgccacgtctgccagtcgcaaccttaggtttccctcaactgggagatgcgcgtcaattaaagcaccttttggaaaaattttggagcggacagtgcactgaagaggagcttatccatggttcccagaaggttgaggaggacggctgggccctccaagctgcgaccgggatcgatgcgattggtgttggggattttgctctctatgattgggttttgaattggattgaatacttgggctgtatccccccccggttcctgcagcatgcccatgcgaacaatctaaccgtgttggaacggcattttcttttggcccgtggtggtgatggaggccggagcggcggcgaaggacagcattcggcaagtgaagatccgcccatggttggtttggaaatacgaaagtggttcgacacgaacacgcactttctggttcctgagttggatgagcgcatcacaccccacgcccatttcgattccctccttgactccctgcgtcgggccaagtcccacctgggtgtgcatcgggcagtcccgatg

SEQ ID NO: 8006 - DNA, 700 bp, Nannochloropsis_gaditana
aggtgggatggtgaccgcaagggtaacgccggcaaggtgataagacatgatccgttggtcgactccagcgcctggatggtttctatctattgtcacaaactccacccgatgtcctccggaatgcagtgacgagcacgacaggatggagtctctccgtccgtgaaaagatgcaaacaaaaggtgcgttcccacgcgaatcaatttacaaagtaagcgagtgcaagcgcgatatgagcgatgtcgaggaggggggaagggggtgcgaatcgctttggataggtaatggactgtaatgagtcaataaaagacggctacgcatgataagcgatgcaaaatggcgtttacacgctatttcttgacggtggcatgtttttcaaaacgcggtctgggctcgggaaatgcaaaggaagtgggtgtggaaggggggaaggaggagaggagagggacaaaactttcttgccctggtcgccaccacgacctccgtattgaatattcctcgccagacgagcctccatgcaatcgtcatgcctgcatggtgactagtgatgggcgccaagacgctgtctgaatggaaggattgacaatgtgggggtgaaagctcctctgaggaaagatcccctgatctgctgcagccaaaatgataacatcgaccttgtcttccgtcccaccccacaaaggataagcgccgaagaggagcatg

SEQ ID NO: 8007 - DNA, 700 bp, Nannochloropsis_gaditana
catcctcgggtaagtgtaaggcttgtcttgctcgtgttgccgtgaggcctacgcccatccacggcatgtggcccaggccgcatggaggccaaaggcgtcgtgaagctacccaagctgcgcttgcttcccctcaatatactgacagtcgagctcgagacaaccccgacccattgtgtaaactgccgtcctgtcgacaaaagcatcctatatcgggaaaacctactggaaggagagtgatgctagtgagtcttccagaagccaaacaacgatgatagaagacggcacctcgttgcttcccatgcaatgcgggtcaaccatgcaacagacctttccacaagaaccttgcaattgagaaaagtgtcccgtgcattgcctgcagccacacgcagcgtaggacgactgacgtgaaggggaaaggaacagtaggagcctcgccaacctcgcctgcaaaagttcctgcggcctcccaggccctttgtcccgatacgacataaaatcccacgccgaggcacgcatgttcttgttctttccactctcggggcagatgtgtacttttttaaagcgtggccgtttcgctttatgaatgcgtatcttttttttttacaagcttcctctctacgaccgatccccacaggaaaacctgggagggagggacgcagccaaatactctcctagtacagtcaaaatattgcacgccatg

SEQ ID NO: 8008 - DNA, 700 bp, Nannochloropsis_gaditana
ggcggcgacgcgtgcctggtacctgagacacgaggggcaaattaaaactgaaaaaggcgcgaacaaaggtctcactagagctgggtaccattgtaactaacgcggccatcttacgcgacgacatgtacacaagttgctgagcttgtgatcgttaatacccaatattgtaatgacagcgctgactgcaagaaaggattaatcctcctgtcctgtgggcatcttcgtctacaccgataccatttcaagttttggggagcatacaggcagggttgacgacggtctccagactcgagaagttggcagcagaagtatcaatactgtaactacattttttctggtacgcgcggaggcgtttaattctataggccccgaaaaaaggcgcttcaagtaagacatacgagacacgaactacccgcaaaaatttacataattaaacacgcattgtaaagcaaatcagaagcaggttgagacgggtcgaggaggtcagccactacatactttcccatgtctctctacgcacccgtacacagagagacatggctccatgcatccgcacgttcttaaacctccttccccgtgtgtatgcctcccctcccgtcgccatctcgccaagccggatttagcgaagtcaggcacgccgaaagcccttctatcgacctttaccacatcccactcacctctcgcgaacttacagggcatg

SEQ ID NO: 8009 - DNA, 700 bp, Nannochloropsis_gaditana
agatatttgagagatccgatgtcgaaagagaatgtatgcagataaacgcactacatgcaccaagcaccaaacgatcggacacacggggggccacgtggaataagcgtgtggaagacggacgcagagggcgagggtgtgtgcgaggatgtgtcatgcagtaactcaccaaaggtactcttgacaacatctcggcggtcctgtcccatctctgcgctcatagtaatgcctatccgtgcgtgtatgattgccattggtgaaaacatccaacgataagatgggttgccatagaccagcgggtttggacagggtgagaaagctgctgctcgcatgatcttcacgtacctcgcgggtgagagacggtggggggcataaaagcgaaagcgggcaccgcacatactaacgtgaagacacacgggaggacttgcatgttgactgggcggtatggagtctctatattgtgtgcacggggaaaagatgagaatatcagcaacctcaaagaggcaaggagagccagccggaggctccgtcgctgacagcggaggaaagcctctcacatgcccgggaaaaacctcaaaacaaaacccacgctcgccgtctctttcctcccaggaacgcccgatctgttcccacggcattttattcgtacccagatcagcgagcgcgatttaaagcgggacgaagacgagacgtcacgcatatg

SEQ ID NO: 8010 - DNA, 700 bp, Nannochloropsis_gaditana
accacgcggcattgcgacgatcctgcaacgtcctctcgatggcttgcagtaatcgagcgtccggatagtcggtaatcatcacgtaggcgccgccgtgcctcaaagccaccatcgagggtaatgcccccgcagctccaaattcgatgacgcgcttgtcccggacaaacgaaggatggttgtcgaggtaacgagccaacaaaaggctaccattccaaatggaaaacgcaaacaggctcccattcgcaccatcatcctcggcaagtgaaatgtgcagttggaaggacggggaaatttccacgcgatggctgccgtgcttgtcctgatcgggtgcggacggtgggcctaattgctctgcaaaccatggtggcagactaatttcctccaggccatccgcagcttcaggcacctgatcactcaaagaccgcaagtcagcttctcggacgtcctccgccatgcctgtgcctgtgaaagataggacgtgtggcattagtgtgctgacctccccctcctgtaggtaaggcgtcatctcatgctgggaatgtggttcatatccgtcagcagtcggcggcagcgacctcctatattcacctgtctcgtcggccgcataaaaagtggccgtgtccgccgggaaaggtctcacacacttgcaataacacctccatttccccgcaggactgtcgttctggctcgtctgatcatg

SEQ ID NO: 8011 - DNA, 700 bp, Nannochloropsis_gaditana
ttctttggaaatttaaaataaagaacaagaatctcaaagaaagagcgagaaataaatttgcgcctgaatccgagtggggcagccagtatgatttttttccccactgttttgggagaggaggtaggtctaactggctcctcacttgcgagaagacatcgtacgcaaatcaatgcttagaaatgataagacattcaattataagtgatcagactttttataatttctgtgcaagacataaacaacataattgaccggacttcgcacaattcagggacaggaactagcatcggcctagatgtcgggaaaagccttttaaaaattcaaatccgttcgattaaacggtcggcgtctgcactggtcattgaggccgtcattacgaccttacaaaatctttcatttattagacaaaggttattgatatttacctccattaccaaatcaatcttgtccttttcacccattgtcacgctttgcttcttatgatacggtggcatcaagccttaacggttccgtaggtcctacatcctcatcttattccaagctttcttgtgcatgctcacttgcatacccatacactcaaaaggccgtaatgtataccattgttcaaaattttagtaatctatacataattttttgcaggtattccgcccctggggccgtaccattgcgtcgccaatttggctggcgtcttaccgcaatg

SEQ ID NO: 8012 - DNA, 700 bp, Nannochloropsis_gaditana
tgttcatctatttgactattatttaagtcgcttatttgaatagtgaaatattgacctacctttatagaggggacatgagatggaatgagtatttcataatgctctcttccctctgcacgcggtgctaagccttcacactcgacaaaataacgtcggacagatgaaactgatgcctcaaagcacataaaaatatctttatgatgttatacttacagatacaagggatgcttaccttttgcaggtttgcagcaccgttcttcacgacttatcatatgatgtggggccaaaaggatacccggcagagcacacatggaaggaccctggcatgcccaagaaatgcaaacaagaagtgagccacttcaaccgcaccctttcactgaatggacgacatgtcagagtgtcagtaccaaactgcgtcgacgctcggagattcaatgacctgtcacacttgcgggtgtgaggggctacccgttcttcgtgtcccacctcttgcagcctccccacccacccaccacatactacagcattttacaagcgttagcgctcaaggctttcttattttgcactgctcgatccgtgctgctaagatcatggtacgttttacctcgcacgttgtttaatttttgcttctactttaatgcttcctcacatgactgcaatctgtgcgcaggcttcagacggagaggaaagcacgcagatg

SEQ ID NO: 8013 - DNA, 700 bp, Nannochloropsis_gaditana
atcctttcttagagccttccaccaggtttacaaggaaaccgagggagcatacgacacccgggaatctcgccactcacctgccgtaagacttgccccacgttcgtgctctgtgtccaacccgatgtgggtctcgatacgggcagcttgggcggaggcgacggggtttggggcaagcggctaatttgttgagaatgtaaaatcattcgagtaacgccccccccgttgccgcctatccgaggaatgctacaagttggtgtttccgtgtcaaactcctccattggtcaccgacgcgaatacgcaagcctactgtcaccgctttttcatcatcgtacatgcgatattgatttccgggtgtttttagactcttgttgacggacagactacgtgtgttcacccaagttcaaacacccccccccctctccccttcagagtacgcacctcgcgaaatttggccgacgggcttctccttgttcacgcctttggacgcttgacccctgcagcgagcaaacaagcccacggtgttgcacacgatcatatcataattactcgaaggctcgctgtcttctcggttgttggaacccggtcgtggtaaatgctggtaaagctggagcttttccctgcatttgttgtctcctttctgccaggcacctgaggcaacaagtgtaccacagcgcgtgcattcacccctacagctggcatg

SEQ ID NO: 8014 - DNA, 51 bp, Nannochloropsis_gaditana
tccctcttgcccgagggcgacgaccggtacgaggatgtcttcgcaggcctg

SEQ ID NO: 8015 - DNA, 700 bp, Nannochloropsis_gaditana
  misc_feature (1)..(689): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatcagctct

SEQ ID NO: 8016 - DNA, 700 bp, Nannochloropsis_gaditana; identical to SEQ ID NO: 4594

SEQ ID NO: 8017 - DNA, 700 bp, Nannochloropsis_gaditana
  misc_feature (42)..(51): n is a, c, g, or t
gccgcccgggtacttgacgatgaccacagctggggagggagnnnnnnnnnnaagggtggataggggaacccccccccctccaatctctttccactctcctttccctccgtatagctccacccctctcacatccctatgcctgctccctcaaatgctgtagcgcctttgccattaagcgtcgttgacctttccgactgtgtcttccttcctttctatccttctctttctgttgttctgaacggcttgtctgttcaaattggagagtaccgtcctcgccccacttgaacatgatttaacgcacgtccattcatcttcgcccaccctccggccctggctttccctcccttttcttgtccttcaaggtgaaagcggtgaccctctccgggtcggtcatcgccaaggacgggaccatgacgggcgggaaggtggaggaggcaggcgggggaaggaagggaggggggggcacgaccgggaggtaaggagggccagcgagacaaagggggcagagaaggggaacaaaagagggtgctccatggggtagagccatcctcgccgatgttagcgatctcagccccatgatttctcggcgtcgtttgtgtgtctggttcctcatctggcccagtctccttcatgcccgaagccttactccacccttcttctttctttcctctacgcacccagatgggacgcgcaagacatg

SEQ ID NO: 8018 - DNA, 700 bp, Nannochloropsis_gaditana
  misc_feature (1)..(450): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttagggttagggttagggttagggttagggttagggttagggttagggttagtatattttatttcacatcttacagcagaggccagagaaaagaaataaactgaactgcagcacttgttaaggtcggatctcgatagagcgaaaaaacttccttggagctacggcgccaaagtcaaacaagacgagcggtagttctgagttcatttggcaacctgttgcttagactagtaaggaggcacttgcaacatg

SEQ ID NO: 8019 - DNA, 700 bp, Nannochloropsis_gaditana
atttccccaaatcattcttaattactcccgtcgttccactcaagggctgtcaatctccttggttctcctgtggcacgcttcagccgtgctaataacaccttacttgcttttcaagcacgaagcgacgcctttgttattgcagtggtcgattttttccgttgcttctgtgcttctggaaacacaaatctacgccttccgggaccccgggctggaggagctgactgaggaggaggaggaggaggaggacgaggggggggggcaggtcgagatggaggagggaggacaggtggcagacgggataagagcgggaggtagcaaccagaagaataatctgacgcgggtgccctccccctcatccccggtctctgcctcctcctcccccgtgcccctccctcccctcatcctgcttgccgtcttcctcctcctcctcaccctacttctcatcgtcgccctctatttcctcttccaagccctcgatcggtcatctgtgggccgctccttcatcactgtcattggcagtgggggctccagcctccttctcgccctaggtttcctccctcaacttcacctgatgtggcgggagaaaaaaagcgcgggcttttccttgggactgagcctcttggacttgctcgggtgttctctgtccatcctggttctgtgcctggaggcgcgccaaggcgcggcggagggaggacgggag

SEQ ID NO: 8020 - DNA, 700 bp, Nannochloropsis_gaditana
tgccggacaggacgtcgcctgagcgcccggttctagtgcactcatttccctctcatcgctcgcacgtttgtgtgctgagagtcgctcctgtgagcctcgtgtccactcccccctgtcactttttccagccccgcgtcgcaggatcatgacacacgcgcctcgcgcctgtacggcatgccattcgtgtgcttgatgttttactggcgtgggtgcgtcgtggtgctcctcttgaagcgtgtgggttgtttgggtgttgtcgtgcccagacgcgcgagggcccggcgaaagagagaatcgatggtcaggggggggccagcctgccatcattttcttcttggtgagcacttggggcattcatctctctcaggcataccttccgcgccgcagccttatgcgtgtctcgacttaattgtagctatgcctctgggggagggtcaaagtttccatgcagggagagagtttttccttgtctgtgggcgcaacttacttaagcgagaagtgaggccctgcacaaaccctccgtgccatgaggcaacatagcagttaccgattccttcatgggacactgattacgtttgtctacgacgtctatccgcgtccctaatcgctcgaggtttcagatagacacggtctgacacgagacacaggatctcacgttttctcttacactcctgaattcccctacaacagcggcaacatg

SEQ ID NO: 8021 - DNA, 700 bp, Nannochloropsis_gaditana
tgtaaacttgccttgcatcaggcgtctcgacgccgatgtcgtgaaccggattgccgccggcgaggtggtggccaagccagccaatgccgtaaaggtgaggaagggagagacgataatttgaaagaggcacatagcaaaatgtatggagtgaatcaattacttgaccaaggggtatgaaaaagatgacaaggacgtcgttgaatcggaggctgtgacgaaaaatggtgacattgcagtatgctaagtgaagtcgcatttttccgtaattttgaacgaaaattaccatactaccaggagctcgtggagaatagcttggacgcgggggcaaagtcgatcgtggtgacggtgaaagacggaggcatgcggctgcttcagattcaggacgacggtcacgggatccgggtaggttgagggccatgtcaagcctcctggtcgtgtatgggcggttgcgggccgcttttcaatccctctgtgcccataaaaatactcttggcatggataggaaggttgaatgtcctggatttgatataatgcaaacgttaaagctgtgaggcttgtttacatacggacttgctgtctctgggtttaggctttcgcattttcccctctactctcattgtctcaaaggacgttccattcccactgtcgtcatttcatgatccacccaaagcctcatctcggtatttttcaccccttcatg

SEQ ID NO: 8022 - DNA, 700 bp, Nannochloropsis_gaditana
ctacatggagcaacaggttctcataggcttattctcacgctcaatttgttcaattttggaatgaatcgcaactacagatacatcacacctttctcaagtacgtcttgcatatagctacatgggtcgaaaacttttctttcttcacattagatactctcccataccagcaaaaagatcgaatttgatgtatttttcgccagtgctaacggcgaaagaccaggaaacccggtttttgctgtgtaggacaaaacaggaggttgacgaacgccgttcgtgacgatcgcggaatccgatgtggaggaggtcgaggagaccctctacttggaacattgggccctgcaatgcatgggcacgggacgcgagaacatcttctctatgctctcagatgctgagcaacttctctcgggcgaatttggaaatggcatatgaataagctgagaaatgtgaaatcagagaaatcccatcaagcctcaagtttccttcttcctcgagctaattgaggcatcggacaagagtcatgcacattcgtaacaacccaaagcggcagagtcatggtctaatgcgcgtttattaagaagttgttcaacttaggaacccttggctttgacttttcttccattttttcggtcactgcgcttcatcatatctccatagggttgctacctgctctcgcggtctagtgcttatcctggtgaagatg

SEQ ID NO: 8023 - DNA, 700 bp, Nannochloropsis_gaditana; identical to SEQ ID NO: 5702

SEQ ID NO: 8024 - DNA, 700 bp, Nannochloropsis_gaditana; identical to SEQ ID NO: 4883

SEQ ID NO: 8025 - DNA, 700 bp, Nannochloropsis_gaditana; identical to SEQ ID NO: 4886

SEQ ID NO: 8026 - DNA, 52 bp, Nannochloropsis_gaditana
catgcgatgctcgatctgacacatcctggccgactacccatcccatcatgca

SEQ ID NO: 8027 - DNA, 700 bp, Nannochloropsis_gaditana
cgaggagaataaattgcagatgcttccttaaaaatgaagaaattaaattttgattttcaagatttttattttgggtgctactttggtcttccctcgtgttttacaatcgtttttttttcctgtaagcatctttcaaacttacaagacaggagcttcgcgtgcgatgacatcagtatttcccccgacatcttactatgcttgaatctggtatttccggcactcttattaacataacttgttaggagatcggcgggtgagaaaatctcatccgcccctaaaaacgttgcgtttgaaaagtcctcggtcgtcggctggcgatgcgggcacacaccactttttttatttttatttttcactttgcaataaagtaccttaggatctgtgcctacgtagcatatctcgtaatgtcatactttcctacttctcttgattaatttgttacagcgttcccttggatatggacgaaaagggtagagtattgcaaggccgtctcgatttttgtgaaagaaatgttacaacgctccggcagggggtcagggctcttttaagaaatcacgatgaaggatgcaatgtgacaatggacctttctcaaaaggttcgcgacacggctgcacaagagcagttcatcgatctgcaagaagacctcatcgcaatagccgaatgtaccaagagattagcagaagaacgcaggacgattatg

SEQ ID NO: 8028 - DNA, 700 bp, Nannochloropsis_gaditana
aatttgaacatacgttgctcatcactccgagtggtgtggaggcgttgacaggtcgcctaccaacctctccgaagtttttttgggaggtctgacgaaacaaatgtggtgtggcgagaatggccgcacgaggagaataaattgcagatgcttccttaaaaatgaagaaattaaattttgattttcaagatttttattttgggtgctactttggtcttccctcgtgttttacaatcgtttttttttcctgtaagcatctttcaaacttacaagacaggagcttcgcgtgcgatgacatcagtatttcccccgacatcttactatgcttgaatctggtatttccggcactcttattaacataacttgttaggagatcggcgggtgagaaaatctcatccgcccctaaaaacgttgcgtttgaaaagtcctcggtcgtcggctggcgatgcgggcacacaccactttttttatttttatttttcactttgcaataaagtaccttaggatctgtgcctacgtagcatatctcgtaatgtcatactttcctacttctcttgattaatttgttacagcgttcccttggatatggacgaaaagggtagagtattgcaaggccgtctcgatttttgtgaaagaaatgttacaacgctccggcagggggtcagggctcttttaagaaatcacgatgaaggatgcaatgtga

SEQ ID NO: 8029 - DNA, 700 bp, Nannochloropsis_gaditana
tgaagccgccctttggccctgtttacctgattgtgcacctttcgttgtgaaatgcgtgggcggttttgaatggtgtgcaaagtgttgcaaacattgagtcgagtgccgacgcagtggcccatttcagcgacccggccttccggtcgccttgaatagaaggggggggctcgtctaggggcgaaacctatggcgaatggagtgtaaaacttaccgcatctaagaagtgcacatcgcccaacactctggctcagagggtggacagatcacgtaacaatgcacctcatctcggtcttctcgtttccgtcacaggcgcttccttcttgccgaagtgttgtcaagatacttgagcccaaagagcgactagatcttgcacgatttacaagagccccatttcgggtgaaaatgtacttgtcctacgaccgatcaagaagaaatggtggtaagctgctcgcagtctaccgatctttcgtcctgcttgttatcttcctctgccatctatcatccgccttccagccctcttctctcgtgcagtactcggggaggtcgaggggagacattctgtgtaaaaaaggatcgagtagcggcagtggaccaccagcatcaaagggatttggatttggtgctaaaaaggaagcaaagggagacaaattcaagtacaccggccgtctaaagcctggtgtattgagtcctccccgagatg

SEQ ID NO: 8030 - DNA, 700 bp, Nannochloropsis_gaditana
tgtgctgttgttggcgggtgggtcgtggatgatgaacatggcgtgactgtgcggcttggatctccatgacgcgtcgtgatggcccaatccacgtcgaaagaacgttttagagatgctccggttcggacacgaagaccccgtcacagctgggttgaataaactgattcctcccggtgaagggcacgctcacactttgggcagggcgacacggcgtattttgttgcctgtctttcgtcctcgtggcgtgtcacacactcgatggcggctcatggtttgggcgtcagtgggcttcgaccgctccatgttgcaaaagtgcgtatgacatgcctttggcagcaagcgagaagggcgtcggcagacaatctggcgtctcagcgcgttttgatgagaaacacttgtttatgacccagccgaacatagtggtatgatccttgtgaagcacttattgtgggatctgttttggacaaactcgctctgactgccaaaagtctcctcctgggacttggcaccacccctgcaacacactcgagaaaggtagcggacgaagtggcgactttttttaagcagtgaccttttacttggtctcacagactttgatttaagtaccactatgtctgtaatactgaagccttgcgttcattcctatcacccgacagcatcagagcacgtcaccttttcccgtgttccagtcgttcgaatg

SEQ ID NO: 8031 - DNA, 700 bp, Nannochloropsis_gaditana
ttcgatgaaggcacggatgctctgggctgcatctgtaagcccctccgtgatcgatgctaccgcggtggggcggtcacctgtgcgcccatcctcattttggccttcagcagcatccaattcgtcgtaaaatgcagcaatataggcatcatcgttagggctgggatccctggatttggtgaaccacatcaggctgcccactgtaaagcgacgtgagagaagtgaaggagtatgtgtatgtcgtcatgcgcagcgtggaggttcagcagtacttaaaaacatagctgtaacaatttggagagcaactcatgcagataaacctgaaatgcttttgtggttgctgtcattgtcacagtaggtggttctcgtgatttctaaaggccacggagacgctgtgacccctcccagtgcaggcgaagaacaagggacatgggcccagccgttgctggacaggcaggagggccgggaggcaagaggcttttgttctgcttggatgcgcagggtccttgtttcgaagccgtgccgagatgcacacggcactttggtgcattagtagggattgggcatgtttattgcacaggtgtcccgtgaaggccattgtaaatcttgtccctcaccttcatcccttcctgtcgttatccccctgcttcctcagagaaccgcttttgcttcgtcgttcttgccttgtctccttttcaacatg

SEQ ID NO: 8032 - DNA, 700 bp, Nannochloropsis_gaditana
aattccccctggtagtccattttctaaccttgctctcaattccacgtcgtcgcgttggtaccgcggtgccgatcgcaatgaaatcgattggaggatctgggcgatgaatcgctttgatgaagcttggcgagtgtgcttccaaaagccggaagatctggctgattctgaaataaatgttatgcgccaccaacatgccatgatcatgacaaatatcgacccactcatgattgaatagtggcgagttgaggatgtaagacccagtttccatctaatttgctcaacaaagatatataagtaatctgacaacgaatgaattgtcctgtgctgcggtactctaaaaatgagggaaaatcatgctcatgtttcctgtatatagagttgaccaacgcaattattggtacagtaagaatgctacagtacaatctagagacattttttgctgatatctagcataagcatattatagatcgacgatcattctaaatcatggcggatgcaggcaaagaggtcgtacgtcgggctcgccgattgcacgtctcatagttgcgaagtcccgcgcctacccggatgtaacgagtaccccccgacaacctcctggccccgcccacttggctgcgcttacaagcgagctctcgagacgggtcaggcaatttcagagcgctttcctcatgacactcgtgtacaccattcattttgtagg

SEQ ID NO: 8033 - DNA, 700 bp, Nannochloropsis_gaditana
ggccaaccaagggtttttccaggatttgatggcgggtttcgtcgagaacgggcgctggcggagcgccttgcacttgctccgggtcttggggcagggcgagcgggaggacgggagggaggtcaagccaagaaccgacctggaaggggcagggaaaggtggcgggagtgaaatgggaggaaaagggcgcggcaggaagacccccagtggtggcaatggggccacgcactcgtggctctcggtcggcttctacgagcaggcggtgcaagcctgcgccgtggcagggcggacggaggaggcgattcagacgctatcccggatggagagcatggggttccggcccaccactttcatttacaacgtggtaatggaggcctgcagcaaagccaaggaccttccccgggccttggcgctgaaacggcggatgcaaagcactcaggtcgagttcgacgtggtctcttgtaacaccctcttgaacgccttcgccgtctgcggccggtgggacgaagccctctccttcctccagcgcatgcccgggcattaccacgtctcgcccaacctggtgagctacaacaccgccctcaaggcctgcgtcgtgggccggcggtggcgggaggccgtgatgctcctcaacagcatgcgggcgcagcgtgtggacccggacgcggtcagttaccggaccgccatgaacgcctgcatcgaa

SEQ ID NO: 8034 - DNA, 700 bp, Nannochloropsis_gaditana
  misc_feature (1)..(238): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccctcccacagcttttcaccaagatggtcatcaaaatttgcgcgaaagcgggggaatggaaaaccgccgggtacctgttgatcgaaatgcgccgggaaggccaattaccagatgccgcgtcctacgccatcgccatgcgggcatgcttggaggccggggagaaatctcgggccctaggcctgtgggaggagatgacgcacgcaggtgtcgtccccaacaaagaagcgtcggccttggccatgagcgccgccttggacctccgggattgggaacgggtggacgcgatgatggaggccttgccctgggaaggcgaaggtgggagggaggttgggcgggaaggaggggcgggggtggccaaccaagggtttttccaggatttgatggcgggtttcgtcgagaacgggcgctggcggagcgccttgcacttgctccgggtcttggggcagggcgagcgg

SEQ ID NO: 8035 - DNA, 700 bp, Nannochloropsis_gaditana
tggcgccagagggatggaaggacggacgcgacgtgaaccattggggcaatattcgagattcaagagaaatgtaccccaattggcgccattcaatttgcgggaggatgatacaatgcgaaggggtggtcaaggtgtccgagcattggagtgcgagcaggatcgaagcatacgcaacatgggcgccgtcttgaaatgcatgctgtcggcagcctgcacattgaacaagcaggcattgacacgaaagcacggtaaagtagcagacagggacaacgagcatttcatgcacgggaggaacactggctgtgcacttttcacgcggtaccaaaaagggattaaaaacgtcgggggagtaccctctcctgttctgtgcgcgcaggccaatacgtcgcccgcttttgttcccattcccagacagtacatttgtactttggagggcttgaaaccctcgtcgtcaatgtacgggattgggagaagtgcgagtgtaacgttgctgctggagcggtgttttggtggctatttcttattgcatgtgccatcgcccactgtcctcttgaaccagtcttggcgacgaatcaatcagtcggagcaaatgcgctgtattaaaatacactcacaacgtgcgcatgccgcatccattcacactgcacagagacgccgagcaaaggctttgaagggcttctggacttattcgtgcccgatg

SEQ ID NO: 8036 - DNA, 700 bp, Nannochloropsis_gaditana
gatttcaagagctaggtatatgtacccctgagagattggctgcgtttcccttttctgactatgatcgagctggcgtcgtggatatcaaccatcgaagaaagctttttttcctgatccagcgcctcaacctggctcttgaggaacagacgagaaagattgcgagagggggtaagatttacgccgtatgcgcgcacattatttttcgaaaccatgcgcactttgacgtgtgctccccgattctcagcatgattgttttatttcccatttcgcatgtcaacacgctcgcatacagttcctacaacaaagcgcgatgaagacgaagccttatctgcgtctcagtatgcacaagtaatgaatgtggatctatcatcttttcatcttaattgtgaagtaaatggacagacattgccggacagattggataaggacggacacggaagcgaacatgaaagcctcctaatcacgaaaagagaagacggtagctcctctaaagcctcgcgtcggacgccatctgcacagtcgttgcccgtatctagcgagctagcagcgctctccacccattctatcgaaaaatgtggacctgaggcagtgacgccattcgaaacagcacacctttcctcccgaattccctccgctccgccctcctcccagtcctccgccccaacctccacgtccacttcctctcctcctgtcggcccga

SEQ ID NO: 8037 - DNA, 700 bp, Nannochloropsis_gaditana
gctatgaccagccgacgcagtttcctcttctgacatggcctgcgactctatgacattgtctttaaccttgttatcctgggcaggcatcaatggctgcttcgactcgtcctctacttggtgaggtgctgaggatgtacgcggcataatgatatccacaacacccccggaagccggatccctgaccaaggaaagcataagaaagatattgtaccagggaggtcacagtaaggtttgagcgtgaagactgcacagctatgcattgaaaactatgccacttttataaagtaccattcgcagggcatgtgatacctacaagaacagggagggtaggctgcatgagcgagatcgccgctcagactggattgtgtcgtgcttcgggttgtacgtgcttcccggtcagaattcaaatttggttcaaattctaacggaaagcgcatctaatctgtccatgtccaattcatcgacgctcgctctgagctcgtttcttttcgatgtgcttcttcagtaccatttctttgtgtttttcattttatcttttaggcctcaatgtgcagcaggaccgcttcccaagactaacacaacttccgttttttttctttcgctaacaataagtgtcccatccagtgagaagcggcttccatgcgatattctcgcagactgctgattggaattgtcaaccttaaagtacaggaagagaatg

SEQ ID NO: 8038 - DNA, 700 bp, Nannochloropsis_gaditana
tccgcgtcctcctacctcctcacccccccccaacacttatcaattaatctgagccaaaccgaactacgacaagcattcaacaagcccacgcttctcacaccggcactaaagcacttctccgccccaatggcgttgctctgcacagcatggcacgtttaccaatgccacaatcaggcgtgcccgtggcgtgcgagcaatgccgctctctggacggcgattcacgcgttatatctcatcctccctccctctgcgttccaccaatgcctcccctccaccactcgcccccgccccgccttcttcctgggatgtctcactgtgtgtctggcgtgccaccgtgcaccatgctgcgacggagagcggtgatttatctctgcacaccgtacgcaagtacagtggaatggtgataggtcgtcgcggggtctggatggtggaggggctcgggcgaagcattgcgctgacggacgaaagccctcctttcccaggagtgagcacttccatcacgggggacagacatggaagctgtcctcgcccagcgtgcatgccttctggtatctgtgctgtggaagctcgcattttgctagtttggtggcttggttggtggtcatgaccactcgtttttccagcctcctgggctcccatcactcccggacccctcccttaagtcttttttcttgcccgtgttcccacaggcttcacaatg

SEQ ID NO: 8039 - DNA, 700 bp, Nannochloropsis_gaditana
  misc_feature (95)..(104): n is a, c, g, or t
ctcgaattttttttcgtagccaattactcgtcttgctggggcagctgttgccatccttcttatgaacctcgtcccccgccaccgccccgccatcnnnnnnnnnnggggggaggatatgatcgttggagtcggaggtggagcagaggttgggagtggggagggatgtagaccgtggcccgacagggccgcttggggaggtgttcatcggggcctgaatggtctgtaagacgatgtcttatccgggaacggagcggtgtacaaagagggaaagggaggcatgtgggtcgatgcttttcgtgtgaatcgtcgaccaagggttgcgctggggttgacacaaaccgcccttccttccaattttttccttctccccgttgcctactcccaggcccaagacctgcgggaggaagatatggagatcgtcagccggctggtcgagtccgagcacgcccgggacggggcgttgcggcgggtcttggtcgtgggggacgtggagcagaccgtctttagcgacgtgctgaccgggcgtggccaaggccatcccatggactgtctccatcggtggatgccgtccgtcccggtccacacgcgccgcctggacatcaactaccgatgcccccacgcccacgtctccttcaacaacctgtccgtgccccgcaatgcgactcgaggggagggacttgtccggccttccccggaaatg

SEQ ID NO: 8040 - DNA, 700 bp, Nannochloropsis_gaditana; identical to SEQ ID NO: 4424

SEQ ID NO: 8041 - DNA, 700 bp, Nannochloropsis_gaditana
gctgtggatttatctcgcttcggggacgcggacagctcacttgacccttgaagagcgtcaaaaggtcgtgcatacctcctcttaatgtggtagcttgcgaaataccggtgccaaatcacaaagatttgcattttttgtacgcactagaatcctccaacatccccccagtccttctgtctcccgcgttctcctcttccgttctctgcccaccttttgacgggatttttatgtcttcccctccatcctctcaaggtaaccccagcatcccttccggtgccaccccatctcccaatcacccttgccacgtctttacctgtgaatagaggccgggagaccatccgcctttcatcgacccgacaattttaaacgtgtgtcccaatctgcatgctgaaaatcctcctcggtgcgttctgtcaagtacttaacgggcggtcggtggcgcaggcgggattcacagaatctcggaacattttaatcgaacctcggctctttttccctcgcgacctggaaggacagtggggtaaaaactcgaattcaagccccaggggcaggaggaaaaggacgtgggcgaccgactgaggccggcaggggagggggcagagcaggcagaccaacggccgagcctgagggaggcagcgaggcggcgaaggaaggaaaaaatcgagaggaggacgcgacaggaggagatggtgtgtggatg

SEQ ID NO: 8042 - DNA, 700 bp, Nannochloropsis_gaditana
gacaacatagtttcttttccaacacagcattcagtaatctccccacaccagtttaatagctatcttgagatatgttctcaatcggtttgcatgcttgtttttcaaagatttcaatactggagttagcctttcggccgccggcgaaatgtggccggtatttgaccgcagctcccctgactttaccccaaatagagcagagaaaagccataaacagcgagaaacttacccccgaaatctcgtcggcattggtagtgcttgcaattgtgtatctaagaagggcaatgaggacattgcggtccaagaataaaccgttacgtttgtactcaaattgatatctccgacagaaggcaaccatgcggtcgaatttgacatcttgaagccgccggctgtctcactgattcggattcttcgtgtcatagttatgacctgacaactattacgtgctgagcgattttctacgcgcgattcgcatggcgcactgctgaaagctttcatgcaacgtgcaacacccttggtgtttcctgcgttcttcattgaaaggcatgcgttactcacgttttttcaccccttacattggcaggttttttggccatacgtcaaagcggaaatcatcgctgtggatttatctcgcttcggggacgcggacagctcacttgacccttgaagagcgtcaaaaggtcgtgcatacctcctcttaatg

SEQ ID NO: 8043 - DNA, 700 bp, Nannochloropsis_gaditana
catagatgcatacaaaatgacgaggaaaagtatgcgaactcgaggccttttctcgcaattgccgtatcattcaacgtacatgttgctcagagaacggcactttgcgtcttcattgtagtcgtcgatattttttctgttcttacctttttttcccaaaatatttgttccagcagcatcttggtcgaggcagccctaaattagtgagagatgtttgacttgtgggtacttttgcgcgcggaaagactataattggaagccaatgctgcataagatgcagtttatctagcatttattactcttggtgacggaggagacttcaattaccgtgattcttcttgagcgctcctcgtcttccccgtcccttccttaaaagtacccggagcgagcccttccgccgacatcgatctcatggtttgtccttcatttgcattcgtaatgaaatgaaaacaagccccctgtttccggcaagaaaatgatagagcttctgtatttccgctctgaaattacgaaatcaaatattcttgccttttaaatcccgtaaatgtgcgaagcccccacgcgcatgagttgaagtttcccagagcaataaaacaaacaaaagatgaatcgtccgacgttaaaaatgatacttacttgtctcacgctgtaaaatgccaacaaatatatagatctggctcctccgcagccaaccgatgcgatg

SEQ ID NO: 8044 - DNA, 700 bp, Nannochloropsis_gaditana
aagctttttctcacacgcatcgcaaaccatctgccagacgaataagagagcgattagaaaatcaggcgctgcgaatgggacttgagagtacgcaatcatattttcaagatgaccgtcgaatatttcccccgccatccttattgccacttacctctcccacagttcaattcgtgtctggtgtttttgattagggtgtggtggagctcaacgggctgaaggcctggcaaagtgaaagaaatttccccagtgctcccactcctactaggcttttcctccaggcggtaatgctgttttcatgacgggcgacaggacggctgttcagagacatccacaactttttccccaaaaaataagctaggataggatcacatggacataattgagaatttctgtgggcatgactatgggagagggggcctttgtagatgtgatagagacatcggggggggaggcgatcggactgagggcgatcgagttgctgttgctgctcaggggaaggtcaaagggcctcatttcatttctggcaacctgtgtataagtgctccctttcacgccatggtggtggaaatcctggccgtgtcccattctgggcatgtgcgtcttcgtgataacatgttcttctacaaacaaaacacatacgtcgtagtgctagcaggaggagcggagtcacgccatccttccatccggagaagcagctatg

SEQ ID NO: 8045 - DNA, 700 bp, Nannochloropsis_gaditana
taactgtatcaagtaaaaggagacagaggaggtaagtcccacggcccacaatcctgcatgctgcttccaaatcgtgccaacagcacagtcttcttgaatatgatgtggtaagggagagtgtttttttaaaagcgaattccaagctatcaggacgaaatttttagctaccaggctgagaaaaattacagctgtggtcaccgcctatgacttgctttggacaacatttgggtgctttccatgcaggtgaacgaaaggtccggtggttagaatcgcacaatttcatcgaaagtttagtttttacgggatacattcatgtacaaggccttgtgaaaacaatgaagacaactcgagtgcttggctgatgggtgcgaggttacttcaatctacgcagcgctaaaagcacacctttcgtaacgtgcgaatgacatgctcccatctcaactgctaatatgaaatgtgtacaattttaagtgtacaatgagatatttgatcaaagaatagagggattgtcaggtctcttgcagggcgtgtgcaagcaatttaatttcgattgtgaggtgagacgttcacgacagtagtgagcgatgaaaaccgggtcttgggtactatcaattattcaaaacatgcgctttgtgtatctaatcaaacactcatgctgtcatttgaaaacgatttcatccagacttggtatccttataca

SEQ ID NO: 8046 - DNA, 700 bp, Nannochloropsis_gaditana
cgtgtgattacgtgatggaatgtgagctaagatggctactcgtatggtcagtcctgcctagggagagaaggcttgaaaccgagcaaagacgatgacaaggaggaagtatctgccgccggaccggagatcgataaatttactgtatgtagcggatggcgcacgctttgaaggattttgacgcggtcattccgatgagcaaaacacataaagatcgtatcgatcttgcaggttgcactatgggacctcgacgtcacgcttgctctttctcccttcaatagaccacctcctcttacgagcctccgcacaacacatacaggtttaacaaacgaaaggaggattttatcttattgagaagtcataagaatcaatgacagccgctaagcaggcaatcatcgttgttggcggcgctggtgcgttaggaaagagtttaatcaactccctcagaacctcccctggcagtagcgccagtagcataattagcgttgatttcttccccaatccacgtgcgacacactcggtccctttaatggcaacaattggatctataacttggcctgaaacggccatgcaggcgttagcaaaagtgcgggcatgtttaaaggacgagggtgggtcggaaatgccatgccgggccgtattgcatgttgcaggagggtggtcagggggtggtgtgcacgaccccggctttctggagagcatg

SEQ ID NO: 8047 - DNA, 700 bp, Nannochloropsis_gaditana
gctttccttcacccttcattcttccaacgccatcacgtttcccttcctctcatcccccgtcctaggtggaagaaagcttcaacacccaggctacccatgacatcctcttccttcctgccttccccccttcctccctcgccgcgtacgatcaccggtccttccccggggccgtcccccgcacgttctggggacccctcctccttgccctacccctacaccttgtgctccccttcctccctccctccctccgccccgcgaccaagctaccggtccaactgggggtgcgtgtcgttctggccctcttcctctgggcagctctcctccgcttccgacaagcggctactttccgcttcggtccccgcacggggcaatgcctcctcctcctcaccctttcccagttccatctccctttttatgtgtcccggacgctgccgaacaccttcgccctaggcttcgtcctccttgcgtatgcctccctcctgtaccgtgcccccacccgctgtctcttctacctcgccggggccacggccctcttccggtgcgacgtcatcgtcctggcgttgcccctcctccttcttctcctcctccgccggcaccttaagctgtcccagctcctcctcctcggcgcccttttcggcgggacagggatcgtcgtgagcgtcctcctcgactcgtacttctggcgcgcaggcagggaaga

SEQ ID NO: 8048 - DNA, 700 bp, Nannochloropsis_gaditana
gcgatcactgccataggaaagagcatgggcctacctgaccataaagacaagccgcggttcagattcgctaagaagaccggtcgtattcttatcgggacgacgatcatctgtgttggactcgcatttctgtataagcaaagagtgcagccatctttcaaacgaacatccttagtcaccgccggaaatgttgtagtggaacccaggaatgaattgaagtcgtcaagcgatcagagggcagagagcgctttgccgagttcgaccctgataccgggaaatcatttgaccaccacaccttcgccgacgcagggggagaagacagctacagatctccctttagaggatgtcattgacgctcaaaagaacgccacgcagcccccgccggtgaatccaagaggtaccgatgtggaggagcaaagggggggaaagaaagaaagcccaaaggaagaagacacgaaggggcgagggggagacggcgagcaccccccgaaaattctcgaaacgagcggagaaggcttagaagaggaatgggaaggagagtttgagcaagatgatgacgaggaagaggacttcttggacgaggagtatgcggacgacgagggggtggaggaagaagaggagaaggaggagggggcggtggcggaaaagaaggaggaagtggcggaaaaggcgatcgaaccggagaaggagaggaaggacgatg

SEQ ID NO: 8049 - DNA, 700 bp, Nannochloropsis_gaditana
gcgcgtgcatccacttatgaaagaaaggtaggcaatgcagtgctggggtcttaccaagtgatgttttgtccatcatgtggacgtagcatggaataataattgcttgtcaaaatatttacaattattctaccggatacgcgaaccattattcgtgagattggattggatacttacagacaatcgtaagcgtatgtctgagcctccaacacactgtcctcactctttcaaatatttatttgcatgtcacactatgacgggataggtgagaaaagatatcagaaaggcaacttcacacgttgttgacggggcggaatcatagaagcccaagtgctaaaagtactgaccaggagaagtttgagcacttctggtttcgtcgtcatcctcctgaatacgagtggagaccaccatcgacatacccgtgtagtggcgcataacgcgttaaggctaggctccacagtgggtgcggcagcctgagtcttcggcgcgcaaaccatttacatcacctcgtgacgctgtggggttggtggctgctgcgctctgcgaaacgaaggtttccttccgcaccaagcttccacactatcaaacagacactgaagcactttgcagcgtgttccgtcctcacacatatcctcacggcgtgtctcgacgccgccgttaccgccaaaaatacctccattgtgatatctgagaaggcaggatg

SEQ ID NO: 8050 - DNA, 700 bp, Nannochloropsis_gaditana
ctgtaacaatatatatcttggcgggcgagatctcaagcaggaggtcatgaaggatcataccttagacgagtggtgctcgttgagtgaacacggtgacaggtagatgtggggacaggccaaaataaaaggaatatatatgctaacaaactcctaaacgcatgtgttgatgaaggaagtgccaaagcatacgagcactcatatcgtccgtaaaggaaggaaaaatgtttacaaagatccagtcaacaagacttaaacaagcaaacaactaactcaacccccaaaaatcacaccaaaaatcatgtacatgcacatcacggcccacaaacgcaagcgaattcacacaaaattaatcaacacaaaccgctcccagcgaccaacatgggccggccggtgacccgccccctgcgttttcgtgacgttcctcgcgcctgctcaccaaaagccttcgacgtcaccattcccggctttccccgcaggcactttgtccctcacctgcgggactgggcctttcggggtcgggacacggcacgacctgtactctgtgtatttgtgagattttattatgtcgtgcttacgatggtggtgtttgccatcgtcgtccttcccggttttaaaatgcagtcggacttgatggcaagcctgtgttggttgttctgaaaaccgtgttctccgttccatttgcaccacgaacagcaacatg

SEQ ID NO: 8051 - DNA, 700 bp, Nannochloropsis_gaditana
cgtcgtcatgctcatccccactattcgctgggactcaacgagatgagcgattggagtcccaaagaacacgccaaacgcttgcatcgacgggatcgtcatggaaatcacatgcttggatttaacttagtagcgggatggcgacggaggtttgtggaggagtttggaagcaatcatcctcgaatttttgacggccgatccgacccgccacccccgcctgaaattgactggagggatgagaagcggaaccccaagcgtgtgcatggtgtgacacgcatacgcaatcaatattactgcggtggatgttacagtttgggggtggtggcggcggtggagggtgtggtagcagccgatcgaggctttcttaatgagttgagcgacgagcaaattttggactgtgatagagtcaatcatgggtgcgaaggtggtgaccctcagcaggctttgcagtacgtcatgactgagcctttagtactagcggctgactatccttttgacgcaggtgccggaaatgtgggtgagtgcgcagcaaagcaggcgccgcctgcatctcagatccgaagttacttgtacgtgcaaccctgtgatgaaagagttcttatgcaagctgtggctaggagccctgtggtagtagcaatcgatgcctcctgtgacgtgtttttgcaatacgcgggaggggtgctttcggactcttgcgtgaacg

SEQ ID NO: 8052 - DNA, 700 bp, Nannochloropsis_gaditana
ggccatcacgtatggtatgggaggaatatcgccaatgtaggcatatgtcataattcatatatctcaattcgtccattggtgaatcacaaccgcttggtgacgatctaaagtttgtagtatggaatttctcctttaccagtcgctcaaggccattccacccggcgactcgttgaacagcaccgtttacacgcgcgcagggcaacattttcaaggctcatcaaaacaacaaaatcacatttcgtatcacaaacactcctttgtatcatgtgtagtaggtcttgtaatacacaaatattattgagattttgtttcaatgacattttatgacatttgtaagaggcggcaccgcgttctggcatctgccaaaccagagaagggaggtgaagatggcgacaggaaagtagggaaaacactccactgagaatgcagcattatttttaaagcgtcattgtatctatccatacatctgttgcattaaatagcagttgtttaatctcataccaggtcaagaggggatttttgtggactgcacggaccatgtactacctcgccctagtcatcgtacagctcgaaagtacctttaaataggattcttactcttccccgtgacaacacataagaaccacgttaccagaaagctttgaaatccgaaactttgacgggggaggcctgctccccacgctggatctgagcaagcatg

SEQ ID NO: 8053 - DNA, 700 bp, Nannochloropsis_gaditana
atgctaacgaaagagagagggcaaacaaccaaaagaatgaaaaggtacttatctccaacacaatttgatgagttttcttcacaaaaatcaacttattttgcctaatttaataaatacccatggaatgtgtagctcccgtgtccaattatatgtcaatggtcggcttaaatagttaaaaaacaggcacatcggcgcgacagaggaggttggcgcgggcgccgctaggaccaacctgtgtgcggtgcccggacgttcgccgctctctgtggccagaaatgcctggaaaggcaggggtttctttcttggtacgtcgactccgttgtacccttctgtgcgggtgtgtatgtagcgctgatgaagagatgatgaagtgagtgttaaacatcgtatatatgattggcaaatgatgcatgaacggctgccgtcacggtgccatcgatggtggtggggggcggaagaagaggcagacagaacgacgggggagaaggattatccacggatggtactcgttaaagctgtggacaccaaaaacgtttgcgttcgacattgatgcgtccctatactagaatagctgttgccgtgttcgaccagtgcgctgtgatagacgctccctggagcctccccaccagagcatatgccaaaacagtagagctaaagccgtcctttatcctacgctatatctaaacaggaggagaccatg

SEQ ID NO: 8054 - DNA, 700 bp, Nannochloropsis_gaditana
tcacacaactcctccagcagctccagcaccctccccgccatatccgacgtctctacggccaaggctagggtgcacccggcttcgtgcgcgttctccggcgggcccgaccggttgaagaggccggtccataccctcgtccccacgtcccgccccacgtagaggtaagtttgattccaagcgtccaagaggaagaccccgtcgtcgatcaagctctcggcggagcatccgttcaaccggagcaagcccatcgagcccgctgtgtcgtcccgcccgcctcccacacccaccacttcgtagagacgagggtatgtcatgtgcaccaagtgcttggcaggcgccgacaagaatgcgtgcaaggtggcggcccggacgtcggccgtggggtccgggaggccgtgggcacgcccagcctcgggggggttcacgcgcagggcatcgctcttcaggagggccaaggcgtacagaggcaggagcttgagcgattcggggaggatcaattggccggggggggaggacgctgcgcagagttgtcggtattggtagagcatgtccacgcaggcgcgtgtcagttgttcccggactcgcaccaagggctccgaccaggcctgccagacggcttgcttgaccagggtggcgtagatcgcttccatgtccgcataccggaagacacccgagacagccgaagccgtcgggagctgca

SEQ ID NO: 8055 - DNA, 700 bp, Nannochloropsis_gaditana
ggttggctcatggcaactgtggcacctccatcccatccacgccaggtactaagccatgcgcaagccggcatgttcctgagcgaggggacgaggaagtggcgcggtctcacgtggagagggaggagccctttgtgcgcaggcgacgccattcaaggggggtgggttgtcgggacgccggggtgtgctgtgttggttagggacggggaggaggctcccaaggaaaagtcaggaaaaaaacctccagattccggccaagcatggctgtcaggacttgctcccccggggacgagagatgctgctgtcagggacgggcaaaacggtggctctcatcgctctttttcgtctgctcttttcgttcttatttgagtcccggccgggcgtgacctccttcggcatgatgcgctgccacacgcgcccatccacctttccttctgtatatctcacgaccagccacatctgccgccttctgcccccagcccctctctccctccctcgccctccattccctgcctcatccatgtacagaccaagccgccctccctccctatctgtactccctcgtgtcctgatctgctcttgagctcttcctgcgatcctgcgtcccccctcttccaccctttcctccctatcaaacatcgctataattcaatgggggtctccctccaatcacgctaccatgcttgaattctatgtacagaag

SEQ ID NO: 8056 - DNA, 700 bp, Nannochloropsis_gaditana
  misc_feature (1)..(620): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggaatatcgccaatgtaggcatatgtcataattcatatatctgtttcccccgcctctggggcttggactgcgagatg

SEQ ID NO: 8057 - DNA, 700 bp, Nannochloropsis_gaditana
ttaaagggtgcttctggaccgctggagcttttcttcttttttttcccagacgccttcacttcatgatgggttgaggtgggacaaaaacgaaataaaaacccgaaaaccgtccacctccaccttccaaagcttaattcacgccaatcatcctcccttcgcgtgtgatttcatggccaagacaaaatgcacgcggcgattcactcgtcacggcaagttgtggagtaggagcgtaagctgaagaaagcgagtcaagcgattctgctgcagcacgggggggcacgacatatgccggtcattaaacctcccacaaaacacagggtgcccggtgaaatccaacaggggacggcaacacagtggagaactttgcaacgatcggaggaaaggtttttaaaggcctatcctggctgtttatcgaggatattgatatctggcggggcagggggttggctgaagctcgggggaggtggtgagctcagtgcacaagatttcttccgttgccagtgacgcacatcccatttctcgtccattaagcggactgtgggcactttgaggcgaattggtcgcatcaagaggggcagggaaggccactgtttaaaacgcagcgtcggaagagagaggcgagtcgtgctgggtggagggcattaactgagagcacgccacgggaaggcagaagctgacacgagatattcacagcatcatg

SEQ ID NO: 8058 - DNA, 700 bp, Nannochloropsis_gaditana
acatgtcctgtattaggggctaaatacatggggtccaatatagacatgggcctagtaagtcttgaagtcgaactgcgggatacaaaggaactcgatcgagatgcgaaaagagcagcgcttcatcaagaaatatacttaaatatatgctctcatgaccttgcacagtcatacgtcgcctgcggatagggatagcgccttccttctgcagatacctaaatcgacgcgacaccatacctgaatcaacaactaaccctctttccctttgccgtccgttctacacataggcaccacaaccccacaggcaatctcaacgccctttccatattaggttccttctctcgcagaccaccgccttttcctcgcttccgcgccaagaatctacttctcccctttcacccgcaccatgcctgtcccccacgtacccagaaattccaactcgagttaccaccgggcccctcccagacaaacctccagcgaccaacgtccctccttctctgaccgtccaccggctacagtccatcaccaattgtctaggcgtatcattacccgaaaggatgacaactacggggagagcaacctgcgtcggctggtgtttttgaccctccaccacccgaatttcagccccttggcccgccttctctccgctttaatgggcctgaccattttcatcacctgccttggcttcgtcctctccaccatg

SEQ ID NO: 8059 - DNA, 700 bp, Nannochloropsis_gaditana
cttctccttttccctccctttcgccgcgattccagaccccaaattaccatgtctcagccaacaagggcccacttattattcaagcgtcttccatttataaatcttacctgtgattggtgacccgcaagtgaagcgatgaccctccctaggcgacccggatgtacgagtctcggcttacgcccaaccgttccgatcttctccgaggcccatctcaagtcctacggaccaaaatgtgccattacgtcgaatgcactgaacattcaaaaggcgtcatattttcaatcctcgaaccaatgttatcggaagctttctagctgtccgtccggtaccgacactcgctccttcgaggggaggactgtcgcccacgctgatggagaagcttcgttttggtccgtgtgatgcaagttaaaattgaaatgcttcgtgtccttcctaagtggtgtattcgtcctggcttgccatcaagagagtttgttttttttccgcgaacagaatagaaatgactggggacaaatcaagcatggattcttcttcatgtagacctcttaagtaatcttgcggtcgtcgcatcagtggcaatggttttgttccacaaaatgtcaacgatgtctgtttaagtcccgtgcttcataagtaactacctcgcccgcacagcagctcgcactttattgagaaggcgtgcaaccgggatagagccatg

SEQ ID NO: 8060 - DNA, 700 bp, Nannochloropsis_gaditana
  misc_feature (1)..(507): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggaggggtcgagggaggggtggtggacgttcgtggggatggaaactgggagtggtctcgtacagtggcagatgaacgggaatcttcatggcacaggtacggaaacaacagcagcagatagagaagctcgcgcacatagtgggcgatcaattgcaccatatccatgccctttcggaagcgttgaccgagatg

SEQ ID NO: 8061 - DNA, 700 bp, Nannochloropsis_gaditana
tcacacgcaccgttcctcatcccctcttccacctgctcgaccctcgtaatcaggactgcgacgacgcgagcggtgcccttgagaatctccacccccgtactctgcggtttctctcccgtcgtgtctcccgttggtgcgccgggaatccttagtggccgtctcccccaggctcctcctcccctccccttcagcctcccatcgggcgcgatgtctcttcccactctcccgcatcgtccgtataggccgtggggcttcacacccctgtgcgcgacgttggcaaatgcaccggtggggaagtgtcctgaggaaaatatcaaaaagggccgtaagttggggaaaaggaggagggcgtgtaagcggaggggaaaggagaggttttatgactttgtcagagcacgcgcggcaagtctcgctcaatgctgaacacaaattgcaaccagcgcaactgtcaggttaccaaggctcttattcctcagaatttgccccacagattggtaaatcgtgcctgtgagtttgaccttacgcgaggctgatggctgaaagccagaatgagaagcgagtggaagctccaggggggttgatgctgaaccatcataccccctcatacgatgatagaaaatacgaccaacctcatactatttcgatttctttcacaccacttgttattatgggacaccgtgcgccctccgtggccctaagc

SEQ ID NO: 8062 - DNA, 700 bp, Nannochloropsis_gaditana; identical to SEQ ID NO: 5605

SEQ ID NO: 8063 - DNA, 700 bp, Nannochloropsis_gaditana
gaattaagactcttttataggaattaaaaacgggttttcgtatcaataaaagaagagaaataaaagaaaaaatgaattgttgcctcagttgcccttgcatcgtccattttctggcctccttgaccggcgtttgaccaaagccctgattttgaccccccccccccccgcatcgccgcctctcgtcgcgcgttgtcacaggccgacgtatccagtggggccttatgcattaagtggatggagacgactagaaggtgtggccatggattgtgatcttccggtgcgtgggggagctggtaggggaaataaacacgacttgtgcggtggacctgcattttatcatcgttcgtgacatttttcatcaaaagtcaacgggtggataggccattttcttttaggagaacctgtacattcctcgcagagtatcgatccttacgcctagacatgttcgcaaatgtcatgaaaaaggatgaaacaggcattttctcggaattttgtacaattaggttctctgttctcaaagtagtattcctgttgcaaacgaccttgcgactcaaatcaagccgctttatttcctccacatctatttgcatttacaggtctcgagggagaaatgatcaacggtctctcatttcggtgttctcgctgagtaaacaaggcaggtgtgttaggtcaggcgggcaggatagagccgtcaaacatg

SEQ ID NO: 8064 - DNA, 18 bp, Nannochloropsis_gaditana
aggcgggggggcttgatg

SEQ ID NO: 8065 - DNA, 700 bp, Nannochloropsis_gaditana
gacttcaaaccgaggtgaaattgtccctgcctccctccctgcctgcctcccccaggtatgcggtcgctctccgccaaggtgccggggaagggagagaggggtctggacggaagcgaaggaagaaaaaatccgaagaaagtcaagaaagaagcggtgatggagagaatggagggaggaagagggaggaggaggaaaaggaagaggaggaggaggacggaggattcgcatacattgatctggagggaaatattgtgtatgtcagcgacgagggggagcaggaaggagaggagggagggatggaggacgaggtcggcccaagaaaggcgcccgtggctgcggaggagggcaatgggcatgtggacgaggagaagaaagagggaaggcaagaggagaagaaggagacggtagagggagagccgtctgcagcaggagcgagcgaggaggtatgtcccgtctcttccttcctccccctcctccttccttcctccgcattcaccctccttccctccctccctcctttcctccctacccatcgccattgcagtcgcttacctgcccgacctgcccccctcctcctcgcaagaaggagattcgggtggtggagggcttcgggctcgccgtcgtcgagtcggctccagcctctgcgtcgcatcatgaacggatcggaccgctccctcgcatcaacgccgccctgaccatg

SEQ ID NO: 8066 - DNA, 700 bp, Nannochloropsis_gaditana
tggcgctgtcgtcccacgtatttgaatccgcttctgcatgataggtggtacccgcatgaccattggtatttccaaacaccattccagaggaatacatctttcggtttggtattaaacagagccaggtgctgcagtccgagaggggaggtaattagagtacgagttgagcaggaaagaatgaatatcagaaaaagacggggccacctattcagcgcgagagaaagcaagtataggacgttgttgacttcaaaccgaggtgaaattgtcatttttcgtcggactccgatgttttacgcagcttatccccaacgggcaccacagggatcgataggaggagcagcctcgcccgcggatcgacggaggggggatgagaaacattggaaatattttaatgccctttgatgagcctttaaaatccacctttgtgccccatatggatacacaattacagaccataccaccgtcgtggagttctgctgttggtttggtttcattgagtataaatatgaggaccaacgccttgagagcagcgggctacaagcatggagaccggaggccaaaagtgttcagctctgtgctctccctcctcttttttgccagcgtcgccaccgcggtagctcacaatctacctgtcgcgtgtagatggatgcgaggagtggcgataaatagagaagctacgaaagaaatccttcctttcatg

SEQ ID NO: 8067 - DNA, 700 bp, Nannochloropsis_gaditana
gcattttttcctttgacgttactcgtttgcaacctcaccttccagatcccgagtctgatgcttgcttgcgggcccgtttgttttgttgttttgctccttttttcttgaaaactggctttttgaaggtgcaaactgcaagcacaaagatcaaaaaaggtacacaacgatgtcagtcgggcgtagcgtggtaaaattcgaaacagaattgacgcgctgtaggcttgctcgtcgcacacaccctccacgggataccgctatacctggctgtgaagagtcccttaggccactactttcgccatcttggtgtcctggactgtcttccatcaatatggacactacctgtaaattacccgttgaaatttttccaaaataagatcagaatggtaagatttagagccttctcttgccgcttgtccttacggcagtggtctcgccggcgtttcagagaggaaagcacgagacctgaagatgataacagaagtgttgccgtcgcggtctggggatgcccttgctttcattgcagtgaggcgccgatcacggagacctggcagtgtacacgggttctttttggaagctatcttttttatttttcacctccccatccccccttcctccccctctccccgattcaaacagataggaggtcccgtacccgactttaaccctcctcctcctgcgacgaccaccacacaaggaaatg

SEQ ID NO: 8068 - DNA, 700 bp, Nannochloropsis_gaditana
cgtaccattcctagatacttcggattgctctgattatcgtatgggcaggacgcttattcatttagacgcctttcggcaaggcgaggcatttttcgggggacggccaagggagtaattgactcagtgatttcgtcatggtcggggggtgctgacgaaaagcaaaaatggcccctcccgccgcccgacgtatgcgatctgaatgtgcagcttgttgtttgcaatgtgttgtttcttctttcttcctgctggctcttgtgacaggatgatttgtatgcttcgtgtcctggctttcccccacggtggttgggagaattgttgtcgtccgttgcgctgtattaaattgttcttggaaggggcggaaattaatttgtgcgcccgcacgggaagttgttttcctcttctggccacccgccctctcgtctcatgaccagtgcgggtcatcttttacaccttaaggtatctacgacaagtgaataataataccttgtccatcacttgtacgcccttgtcctgcgtatgcggatgcggtggtggtcagagcgtaatgcgaagaaagcatgcgcaaccccctcttttgtggtcaagcggatccgaagccagcgaaatgaaaacatgcatcccgccgtacgcaagtctcctgacgtatccctcacttctctccccagcagatacctccaacacaccacctcttacaaccatg

SEQ ID NO: 8069 - DNA, 700 bp, Nannochloropsis_gaditana
gacttcgatcataaagactttctgctgccgcttatggctgcatgcggcccatggcgcgatttagtgcgacacagccccgagggcggggtctccctccttccctctgccaataagatatacagccagtttttcgaagaagataactcggcctacttcattcagtcataacgcttctgcaagccagcttacattttattgactgtgtaggaagcttggagctggtttctggtgaggacaagcactcacgaagcgtcatacgtaccccccgaaggcgaggctaagaaagcttttttggggttgtttaccaccacccaaacaaaatgacccgcagatctgactaatacagtagcttaagcaatcctagatctcgcacgattctaccttgttcttgctgaaaagcgtcttgcaggcgtatgccagggatatgtgctgtaatcgccggcaccgtgaccttcgagggtgaatcatgacataacgtcgcgttttcttgagcttcgatgcacgtgtgtcgataaagccgctgctagctatcccggtcactagatcacatatttacttgtttatagtggcccaagaaataatgtgatacgcgcgtgtgcttacatttcccagttatggataacagcgtctcaaatatcttctaattctctcgttcctcgtactcccccctccttccagttttctgcgcattacacaaatg

SEQ ID NO: 8070 - DNA, 700 bp, Nannochloropsis_gaditana
  misc_feature (511)..(570): n is a, c, g, or t
gaaaatgacgacgcaagtcctccacaaccgtctctcttggaggagatcctacgacgcctccgcggagatttctcccatccgttgacggaatcgacccgtctggtggtgcattacgactgtcgtgactatcgctcaggccttcggggcttagggttgcggcacgtgtggcgcgacgtgggcctgagtctgttgagcgatgaggacacggccactgacgcggcgttgcccatgagcctgggaccggcgctgggagaacaaggttggcgcacctggtgtttcccttgggaaatcagaggaggcgtgtcggtcaaacggatccaaggcgtgagcgtcccacaattctggcggatgcgccgggtaaggggggcgggcgtgcacggaaggaagcgtgcgtgtcggacccccctctgtctaagctctcggccctccctgtctgcgtgcgctctgtctgcaccccgtcctctgggcttttcgtgggccttcgtcgtctatgtgtggacccgatctcaannnnnnnnnnnnnnnnnnnnnnnnnnnnnnnnnnnnnnnnnnnnnnnnnnnnnnnnnnnnccctccctccctccctccctccctccccttcttccttccctccttgtcttccacctagcacggccatcccccgtcgccctgccttccggccctccatagatctgctctctctcggccttggctgtgaatg

SEQ ID NO: 8071 - DNA, 700 bp, Nannochloropsis_gaditana
gttaacgcatgcattccaactgctatctccgtgcaacgaaggaaccaaaactgtctagcacgtcaatgtagaggaagtatcctgtggagccgaaaaataatcaaacatggattaataacgttcatatttggtttcggaaaacaggtggtggacatggaaatggcatcaccaacacacgacccaaagaaagtaatagcattttcttgtccggggaggttattgtttgtttcttgaagacagctgacttcgcactcggtagttggctttcaaaaatgacctcatttccacgttcgagtgattgaaagagatgagtccatagacctgcctaaacctcgcatgtcatgcctgtgaggcctaaatttctaatcttgtactgacctgtccatactcacggcacatttggctcttcttatcaaaggcatggccatatttgaaaatgtctaatcgggtttctagcccggctagcatgacgtctccatttcctctacgatttacggcagcggctcttaaatcttttgcacgtcctcgtgtcaagatctttatattatgggctttcgtattttttggcggaattcaagggtggttatggtgggggctcgatgccagcgcgagcatgcctgtcggcagtctctttttgtcctccagcctcccaagccctcccttgcctaaaccgaaccaaagtaatccttgtaagagcatg

SEQ ID NO: 8072 - DNA, 700 bp, Nannochloropsis_gaditana; identical to SEQ ID NO: 5942

SEQ ID NO: 8073 - DNA, 133 bp, Nannochloropsis_gaditana
gaccttcacccctctctcatccctctccacgcttgaccgcccccccccccaccttagctcttccccctcctctcctccttggcccgcaccctcctcctgctctcctcttaccggtgtcaagagtgcgtggatg

SEQ ID NO: 8074 - DNA, 700 bp, Nannochloropsis_gaditana
ctttctgaggttcagtgatacattgtgcgtgacgtcgaatgcatttatttcatagcccccgtcactgaaagggctcaaggtccatgtttggccattgacgcaaaagaataccgacacacatcatcccgcttcttgcgtaccgtgcatccttgcgctttgtcaaggaattgacccgccttccatgggtatcagagccccgtggggaaggttattgtatgttgttgagggcctcgctacctctgctatcgctcaggcgggtatagagacatttaacgtcccaacgtcttttccaaccataaagccactgaaaccacgcaaacaagatcttgaggatcccacattccttccagattcttaaatattgagttccttaccgaatgcctccctggtggctggttttgaaagcggtttacggtccttttgtgcactcaatcaaatcagagcacttgccccttcgacgcactcagaccgataccccgccctcctgaataacatctgcgatctatccaaacacatagaccctcgacgcacacaatcctcgtcttccgcagcgtcacttttccttcgacgcggaccaggtagtgatatttgcgatatctcccaagacggcggatttttttctcatttatttatcgcagactttctctccctccctccctctttcttttccctcaatcccctccctgcaaatcaaagcatg

SEQ ID NO: 8075 - DNA, 700 bp, Nannochloropsis_gaditana
tgaatctttaaggcaatactgacaaggaaaaaaattactgaagtaagccgggataaaaaccaacgaggaactaaaaaaagaagaaaaagtcatgcgcaaaatctctgcattcaatgaagatccatgctatcagttctaggccactcgcaactcattttttggcttcagaagccgtcgtttatcgtcctacttttagcgcatcgcgtctcgaagtgccctgccaccatctacagcggtcagacaaggtcagtacttcattcctttgtttttagtcatcacaaagaattgaggtatatgtttaaggcaccatgatgaaaatggggtgggaaatgctattttcgcatacatcagacattccctcgcatttttcaagaggtaggggggaggttaaccttgtgcccggcattgcgaacatggcaaatgtcctgtgagcacactcgaatgccaaaaacgatgctcgctggcgtctttttccagtgccaaagtttgctttaatggcccttctgatgcatcacttgttccctaggatgttaaagtccgcgtacagtcttgcttttcgtgttcaagcggcgttcgttgcgaaccgacagactacctacaagtaccttgattcacgtctctattggcaattttcctgtaacagtcaacggttgagaaaaagagcaaatcaggtacgcaataatacggagtgacacaaatg

SEQ ID NO: 8076 - DNA, 700 bp, Nannochloropsis_gaditana
agcatagataaggcataattccgtgcgtattcatttcgtacgtccccccaatatgtgcaacgtgctcgttcatcttcaaaacgaaattctcggggcgtatatatcgtggctttttcccgcgtggaatggaaaaaagctcggatctgatgcatggcgtcgacaaatgactacttcattcccctgacaaagcatgtcgcacgctctgtttcaaggtcctgtcttatgcatacaacatactgactgtgcgactggttgaatgaataatatattttttgcctgtcaaaatactttacgacctcctacaatccggcttcgggttgagattctaaacgtgtaatcagcagccttgcatctgactgcgtgagttttatgagtagcgcgtcacaaagtacgtaactaccacctcctgccccccttaaaaaagttccaacattgcaacaccaaccctgggtattcacgcaggcgattgagtcagtgtgctgtggtttattagtctttgataccgaactgcttcaactattactggtaagcctcggtaaaagcccctgcaaaggcattctgcagacaaggagaaaacgctgaagcaccgagcgtttggccaggacatgaacgtatgataaattcatcgatttcgtctttccttaaacatattttcaaacccttttcctctcatccagccaaaaaccgagagagcaggatg

SEQ ID NO: 8077 - DNA, 700 bp, Nannochloropsis_gaditana
  misc_feature (517)..(565): n is a, c, g, or t
catggaaaatgtcccgtgttgttgaaccgaaaaatggacagagcgtcctccaggaaggaggactgcttcgatgccaaggaggagatataacgacggagctcttccacggggctgagactgtcagcatctccaactgccagcctccgatcatcttctgcgaccagataggcccgctgctgctccaccacttcctcattgatcttggcgacggtggagttgggagagacgcgtaccgaaggcccaagtgagtcgtaccactgttggaaggcctcctggcacccggggaggaagtgaccgagagggtggccaaaaaggcaggcaaatgagggaggagttagaatggtgtgccacctctttgctttcatacagggcatctccagtcatggtcagtattgccttgagctatctctccctcccggtcccatctccctcccaatcctctcttatgcccgccccgccctccaaaccctcctccctcccttccaccaccctcccctccctccttccctccctcccnnnnnnnnnnnnnnnnnnnnnnnnnnnnnnnnnnnnnnnnnnnnnnnnnttttggttttgggtgctccggcttcacggctcgctttttatccactcatgcctctctctcctttcctcgtcttcctcttttcctccctctcatccccatccccgcccccttccctttctcttcacacttgtcatg

SEQ ID NO: 8078 - DNA, 700 bp, Nannochloropsis_gaditana
ccacagggtcgttagccctttcctctctccacacgtgcccctccgctccctctcgaccaagaccttcaagcacctccttgccagccccaacatacgagtacgtttgtccccctctgtaaccgtctccttcaccccggcttccccctcttcccctttcccccccttcctactgctctcctcacgtcctggtagctccctatcctcctggtcctccacctcttttccttcattcttattttgcgccaccagagaaatgccttcctttgtctgccgcacgtttctcaacgaccggcattctaccttcccctctcgggcttgctttctatcgctcccttctcccctcattccctcctcaggtccggcatgagaacaccctcttcctcctcttccagatctatttcgctcaaaaagaagactggcagggggacacaccggaagaacgagaaaagtcacggcgggcggcggtggaggaggtgaggaaggaggttaggagagaaggaggagggctaaggaggttaggagagaaggaggagggctcccacggagaggacatacagggaggagacgcatcgatgtcccatgaatgggactcctgaactttcttaacccatcttcccccccctcaaacggtccgtgtgctccgtcttcctttcattctttcccctctcaggtccttccctccctccgtttcccccgaatg

SEQ ID NO: 8079 - DNA, 700 bp, Nannochloropsis_gaditana
tttgaaaatagacgataatttcaacctttgttgtgggcagaaatgtgccagcttggttttgatttctgcgaggcccatgctactatgcactccaagccgtcgcccaaaagagtaccgccttcgccttcgaactgctctattatctcttttgaatgacactctgcacacgatgggcccggcatgtgtgaagcctactttacattgttcatggcctcttcatttttgtgttactctggacaactgagttcgatttttggtgccgggatgatgccgaatgtcttattgttttcgctcttttcaaatgaacatggggcacgtacagttacacggaagaaaatgtatagcgcatccaagtcttttcgtggacaaagtacagaacatgataacatgcgtccttgatgttcgaatttgtaggcaagtaaatctactgacgtgccaccggggggaaaactccttagtcctggttgacgctgcgcttcctttccttccaaagcgcaccgataccacgtgacaaggctgacaaaaaggaagattaaggtgtgcaaggtcttccccaaatcatgcgctttatccgaactctggtctctgtgaatcacgtaaatttttgttttcgcacctcaacaggtcgttctcctgcctggctgcccccgacgtcatgtctgtcgggcacagcaaaagcgcggctcacgcagccaatatg

SEQ ID NO: 8080 - DNA, 700 bp, Nannochloropsis_gaditana
tgcagctgtgttctcggtccacaaataccggggactgcgcctgcactctgcctcccacgagcctccctgttttttacttttcagccaacggtgaagtggagcataaatgccacggaacatgacgaaatatgtcttttcttgtcgtgacaatttgaaaaaggcgtcaggtcgtttctgtctcatcgtatggagtctacaacaggagcctggtggtccttagctagaaataaagtcaatccgggaaaccccggttttaaaaatccaaacatgctatcgcacgacataatttgaagagtttccgccaatctttcgtttttcattcatgacttcccgactttcagctccaaaacggaggttgacggcctccctcccattcggtccacaagtagccaacgcccttgaccgtttcatccggaagtttgattttttggatgaaaccccgaaattttgggtaacggctcatttggacatacgccatggctatgtggtcctgttgtctatgggagccgcttccagcctctctctccccatggcggtttggaccctctcgcattgtctctgtcgatatctgtcgtgatgttgcagatgttttgcttcaagtgatatttgaagtcatgtgaagcatggcaagtgcatccacttcgacatagctttcgatcttcccgttagcagaacacgcaaaaggagctaaatttgccaa

SEQ ID NO: 8081 - DNA, 700 bp, Nannochloropsis_gaditana
gatagttcagtctttacactgtgaagtaagcaagcgaattatgtatttttttgctgacactcctactcgcttattctgccttcccagctgttgtctgtacttttatttgtgcaaggtacgtcccaacgtcctactggctctcattattgggtatgacaggtcatcaatactcgccggcatccgtatagtgggaatttttctcgtgtgtaaaatgcaatggctttacctacataaatgacgatcatcagtatgtgagatcgcacacctcaactagattaggagacctgtacctcgagtactatatcatttattcttatatccttattaagataatttaccttgagcacaaacaaactttgggacgtttaatgttcatcattaacgtatatttccaacttttacacgctttttaattcaacacacatgggcaaatgcatgagctgaccgcgtgttagcgatacaagtagtatttgttgagtcgtcttggtcttacttctcgagaaaaattgatttccaccccacgcttcgcttcttgtgcttcgacaaggctgccaagacgaagatccttgttggcgatttcggcgatgcttcaacatcctgacgcgggcagtgtgggactcctttgtgatgaacagaactatacacgatgaggcctcacttgtatcttgctccttttattttcgcaggtggttgcagcttt

SEQ ID NO: 8082 - DNA, 700 bp, Nannochloropsis_gaditana
  misc_feature (1)..(274): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgggagggcgggaaggcgggggtggaaatgtgatgatgcaaacagaggcccaggaatccctgcagtccatggtagatagacggtggttggcgaccatcccgcccacggataacgacgacctttacatcttggagttcgcgcgggaaaaggtacgggacagcgggggggaagcatgggtggagggagggaggggagaagggtgggagagagaaagggcggacaggaagggcgacatcctctgtgtgtcgctcagctccctgccttccaacgtcacccgcacactctcatcttggtttttgaagtgctcctttttaaaaaaaaggtccttcttacgttcaggcccccatcctcgtgtttacttgcccttgttgactcacccttgtccccgtttccctcgaccagaacgccctcgtcctctcgaatg

SEQ ID NO: 8083 - DNA, 700 bp, Nannochloropsis_gaditana
tctcgtacacaaaaaataaggccatgaaggacaaaccagacccgatcagaatcaaggctagcgtgccgaaagccgctggattaacggggctatagtacggggtctggatgatcgaggaggaagtcagaaggaacgctaaaggtcgctgcgcgaaggaggaggacacggaaatatgtgcctcccgccatttattatacatgcgtgtaaagcaagaaaaaaattttcgtggtgctgtgtttacctgggaggacatcgtggtggaacgtggggagaggaacgtctggcgtcgaaaagctccgtcctgtgtcagatgaggacaggtggggggggaagtcaatcactgcgcacacagtagtccctagcaacgagtacatcaagttgcgatgacactgtatactcaaagctggtcatgagcatggataattcggttcacggggacggagcgagacatttgagtgggcattcaattcctcagcgagtcgagcgaggggtgtagtagacacaccgaagcacttacactttatacacagggagagggaaaaagaaaaacccctcccgtaaacaagaaggctatacaccattcttgtgctctggattgcctccgcacggccagcattgtcgttgtagacattgcattcacgtgcgcatcgattcccaccccctggcctccgacagtcaccgcatcggggggaagtggatg

SEQ ID NO: 8084 - DNA, 700 bp, Nannochloropsis_gaditana; identical to SEQ ID NO: 4941

SEQ ID NO: 8085 - DNA, 700 bp, Nannochloropsis_gaditana; identical to SEQ ID NO: 4951

SEQ ID NO: 8086 - DNA, 700 bp, Nannochloropsis_gaditana; identical to SEQ ID NO: 4959

SEQ ID NO: 8087 - DNA, 700 bp, Nannochloropsis_gaditana
cagtagtctcgcaacgggagcggttgtgctctctctcctttccgcttaaacggaataatttatttttcgaaaaaccagtcaaatcctattaaaacgcactattgatggtcatgcatgcatctcctcttccttacgacaacgctcgtaccactggtggcaagggtatgaaatctccgaagcctgaaaatggactcccgaagttcctttatcctctttacacgttatccccgaacgaaagctccactccgtagtattagccatgcaacctacgtcctttcctctgaacaccatgcactgcttttaaaacacctgcaacgcgatgcttggtgtctcgactaagatattcgggatgcgtggtgtatttaagcgcaggaaagtcaggcaccgcccacagtaaatccgtgggggaatgtccgcgctatcttccgaacaagcagatggggagactttgaccttactctttcatggaggcgtcttcttttttgtgtagattcgtatgctctgcggacaaaaccgtctttccatcgacggggtgttcatttcggtctcttgggcttttgttgaaagcacgcttgttaaaaatcccctaactttctgtttcgtttcgggatttcggaagagagtcgcacagggtatgaaagtcgcggtccatgctaggtgtgcaacatagccttcatataacaagtacctgctcacaatg

SEQ ID NO: 8088 - DNA, 700 bp, Nannochloropsis_gaditana
agtggggcaattcatcaatcatattgtgccctcactaatgagccgtgaagagagtcctttcttgcatgtctgagtgcaaggccctccacgatggcgacacaaggattgtcctacccacttaggtttcttgctcaattaaaaagcctgtacatattcaatcaacggtatgcacgcacgaggcacgtggcaccagtttcagcatggcagcacggcaaccttgtcacttgctgcctcggcccatctccggtaacggacaatccgttacttaacggctgggcccgatgttgatggggccgatgatgatgccatcctgatgcggagtaaagtctgtcttgttgaaatggcttgccaaggaccctgggtgcgttaaatatcgtaccgccaagcatcacccacactcgtgccatcgtcaggcgcgtggtagcgttttacatatccttgaatggcctggagggatgaatatcacaagataactcgtcttttggtacggagcatgctgtcaaattgcccgtgtactacttgaacgctttcgaaaatgatctcagcctcttccttagatgctatgaggaatgattataaaatttgcccgccaaaactcaaagaagcttttgctttgttcaatactactacgctcttcccccatattccacgcaggacgagaacaaacaacgctctttccaaccacatacccatttcaatg

SEQ ID NO: 8089 - DNA, 700 bp, Nannochloropsis_gaditana
gccaagttctttcaccgtacctcatcagcggcaagatttgcagtcgtaacgattgtcgtcgcttcctcctcgggcttcttgttatctccattttttggggcatcttcccccactccatcctttttatccttctctacgtccattggtgccatatttgcgtagagactctgtgacaatgaactgaaacgtttagtggcgtagttggtgtagagaaggtttactgctcgctgaagacgtacttcttcgtcgttccaacgcctagatgggcggtcaggcaaaggacaacaaacgctctaggtacacttgcaagcacgactcactcaatcaaaagagactacatgcgttcatgcatgaataactgcgctgacagtggtagttgtcaaggaaaaggacgggaacggggaagaattctcgggcgatgacgtgcgatgacgcccgttatgtgatggaatgtgccccttcgattgccggagtgcaacttggtccggtgccctccccgccactgggaactgaccgctcccgctctgaattatggctggatttttactcacattgctcgacacatgtctgtcggtaacatgtactcctgcgtgacttgcttcaataatttgttttgatattgtgttctcttgcttctgcctatttctgaccatacgatacgatctccccatttccctcaaacaaaggaggaggatagatg

SEQ ID NO: 8090 - DNA, 700 bp, Nannochloropsis_gaditana
gaggagtgttagggaaaccactacaatcggagagattggatttgaagtcattttggaaagcgtttaaagatatgccagaaggaactatgaaatatctattatgataccaaagaaacatgcatcctttttggcgttgtctggctctcgatatggaatgctaaggacttttagcttttgcaatttgcaaattgtactgtaccaaacattcatcttctcacatcgcatttcattctcaaacctattttttagcaatatcatattattcgtaagtattttatgctaccggctgtgtaattgccttcttacctgcggtgtgttcgtaagaggtggatgtccacttgaagaacattgctttcaacttgatttgccatgcagccaacaagtgctctctttcaatttttaactttgaaaagagcacctagcttcaacttttcccaacaacttctcatgtgttccgaagaacgaacatctgtacctgaaaggacatcgcatggtgtgcatggtgtgtgccgcacttgcttgaagcatttcgtgtgacgtcacgcaatatcagcccccgccgcagacggccacaactccgaagcgatgcaagccggacacaaaatcagccacacggcgtagaacaaagtgggggaagtttcctatttggggtaaataatacgtagacatgcgtatttcaagccatatttttgttgcaatg

SEQ ID NO: 8091 - DNA, 700 bp, Nannochloropsis_gaditana
tcttttctcttcaatgcatcgaaaaagttgtagatcataataatcattgcggtgctatacatactgtctttcaccacctcgcaccgtaccgatggctaaaatcacagcggaagtgtatctaaagtccgtctcttgacgtttcttgtttgaatttttgaaagattttcgcgagagaagaacaggccgagcagccggtgcaagacatcatccaaaagtcgtacctgccaatttgggcaaataaggtgatttgtggcgcatgattgcccctttgcgctcgagtaatcctgtggcacctctatatcggtcttttatgaatgtccgcaatgttcataacattgcataatcagcgcacacttttcgtgaacgtatgttccacgggtccagattctttgtcgcattccccccttcagcttataaagtgtcccatatgtcacagaaaaataattaggtctctttttctgggatgttccacagttaatttcaaacatggatagtacattgtcgggagccatttttacacagaagtgcgtaccaaagaaaagacgatggcgtcaccaagagcagaaatctctgcaaaacatacgcctagaaacttgccacgaatttagctatcatatccgttctgcaaatgtgatcgaacctccacgtttccacgcatctggtctgagacgtgacgcgtcgaaaagtccgccctggaatg

SEQ ID NO: 8092 - DNA, 700 bp, Nannochloropsis_gaditana
cggtctttgctgcaccgagttatcctggtgcttttgctgccctcgcccttgttgctttcgttgttgttggtgttgtactagtcgctgttgctgcggcgggtcatccatcttacggcgaaagcatcctagtgccattcgagcattggacaaagcgcacgagtaaggaaagtggaagaagtaaagaggtgtctgatacccgacttataacgagaaacagacaggcttgtacttctattggtttgcttccgttagaaatgaatttgagagcgtactggtatagtaagtcgagaagtcaaggtgacggaacaaaaagcgagcagcagcgagagcttcaatgaaagaaaaatacctttttttccgatcagacggaaactagacctccatcgcgcctattatgcaccactccactggtatatttttatgtgaagctagttttggtagcgtgtgagaccgtgtaaggagagccgacccgtgcatccccgaatgcaaaggcattactgagggtatatgattccatcaccgacaaactttaggatggaaacgtgcggcgtacgcagggttgttcttcatagccagttttgatcgtaaatgcctacacatcacaacaaatttgaaaagaagggtttccaagctctcgaagactaactcacctttccttcccatcaaaggggttgccacgcttacaattgagatcatcatg

SEQ ID NO: 8093 - DNA, 700 bp, Nannochloropsis_gaditana
ttctaatgtgggcatttttggcgcgaaactttctgagagaacttccgaggaggaaggaaatgggcgagtacccggtgttcctacgcgtgggcggcgcaaataggaacgcaagcatgaacaagcctgcaggcaagcaacgaccacaacactaaattttgccactgtagttatcggacaaatcctatggtggctcgcctttcttcctgtaaagagacgatgctcaaggcaacaatccacagtgctaatgggccccgccccgttcccctcctgcgggtgggcccaaaatactcacgaatttgactaaattgtacccaaaccctcccaacccgccacattatgaagacagtggtaaactttttacatctacaaaggtatactgttggaggtttttttcatctttgggacggagtagggaaaaagaagccggtgtactcgctaattcgaacttctcggatccggcagaagggctttcaaggacactttcctgtcgccagtaatatttcttttgctcgcgcacacgcaacagcctgagcttaaattattcataaagtgcgcatcatttgctcggtgtctcgttctctaaatcgatccttccttcttttccttctcaatgccttgccgggggtctttcccctagataccaccgtggtgctgccatgaccatatttcctgcgtggcctaaccaagagaccagaacatg

SEQ ID NO: 8094 - DNA, 700 bp, Nannochloropsis_gaditana
  misc_feature (546)..(666): n is a, c, g, or t
cggctattacctgacgggcgacaacgcgaggtagagggctggagggagggaaggagggagggaaggggggagtgcgggcacgtcgacgatcgtagctatgctcatacccctccctttaggcgcgactcagacggctactactggatcacgggtcgggcagacgacgtggtcatcgtctcaggccacaacttgggaacggccgaggtggaggctgccctggtccgtgcacccctcccttcatttctccctctctccctctctccctctctcccgccctcccttgatcctcgcatgtcgttcgctgtgctgaggccaatcgtctctgacgtgcattcatgcgctgcctcccttccctcctccctccctccccctctcccttcccatcctcctgctccctcccacgcaggcccagcatcccagtgtggccgaagcggccgtcgtgggcatcccccacgacgtgaaagggaactgcctctactgctatgtgaccctcaaagccggccaagcgcccagcccagacctggagaaacagctgaaagtttcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgggagggaaggagggcgaggcagacggcatg

SEQ ID NO: 8095 - DNA, 700 bp, Nannochloropsis_gaditana
agaaaaagagggcgcaccgcaccatttcaccagatagtgccgtgacaaacctggaccgaaatgcgatttcatcactgtgatatacattcttaaacgtgggaacgaggcaggctgacaaacaggaaacgtatgaggaggaggtggagaaaagcggtgggtggccgtaggacgctcagagcgatggggtgggcaatcttcgctcagacaggtggacaggagtgatgcccgaccatgtgatgataagtgggggctggcacccaaagcagcacgcttatggatcttgcgctataacgcatattgaaatgtgtcaaccgtaaattggaccaacgccgccagtcccttgtttttcatcacggcgtgcccgtgaactccggctttccattctgacgatcggaacggtctcccctttaggccccatcttgtggaccgagatgagccagcatgtagcgtagcgcttgacggtgaaaaatgagttttcagtgaccaaggtggcggtaaaatgcactgctaccgcatccctgctttcgccttgcacctgttaggagcattctttgtatttttaggaaggatggcctggatatgacggcgagattctaggtccaggtttgtctgcgtttgtgcaagcgcaatcgcatcgatgtgatcctgtgctcttctgctcaagtcaacaaatttgcgtttcacttcccacagaggcatg

SEQ ID NO: 8096 - DNA, 700 bp, Nannochloropsis_gaditana
ttacagaagttgctgccaacgtaccctgcattgtccttgtcgatgtattttgtgaccttcgcgatgttcgtgagaacgattaccgttccacatataacagtccacgcaatcagcgctgagatgggcgggcttaatgtggacatgacacccggttgctctgctgctaccactgtattacatgagagtgaatgcacaagaggggcatgctgaggtgaaaagacgcgggtaacaggatgaggaacgggttcgaggactacccactccgaatccctgcaatttgagcgcttgaaggttgtcgactttgcaaggttgtaatgccctcaagactccaatgccatgtcgtcacacccaaagatgtgcgcgggatacgcatctcatgatgcagcccgtgaatttgatgtgtgagagcagagcaacgtctcccggtacgtttgattgtgcgttggctttcctgtgtatcacagcgcaagtcgtacacgctccgttgagcacgccgttacctgtacgcccatacaatcaatcgtagcttgtaaaggcgtactcgtcgcgacctaaggcgcggcacgtggggattgcccatgtcattgcggtcgggctggaaagttgattcctctccttgggcccgagtcgccgattctcgcccagccccagccccgacttcatcaacctcacacctcttgcctgcgactcaagtgcaatg

SEQ ID NO: 8097 - DNA, 700 bp, Nannochloropsis_gaditana
tgtttggatttcttgctgtatgcccccgtgtcccacgtcctatgggaaggaagggcgggagatagggtaaggcctcgatgcaggcgcgagctccgtcaccacacgttgcaccaagacgactcattgggtacaaaacttccctgcacgaacaattgcagtcttatcctaggctgacattttctaggtcatgcttgtcaacatcgcaacccctcgatccagccatagccctctgggccctaccgtagcatcgttgctatcaatggacaaggaggtgggactgtcagcattggccgttcgaaggcaaacgaaggcgaagaaggaggtgtaaaagagagcagaaagacgtcgaagctgtccttgcccgcgcagccgctgttgctttcgtcgatccagggggcaggcgccagtagcgaggttcctatgagttgtactgatacaggggacggcgctggataaactcataccctcagcgtgaggaaacctgtgttcacaagatgtgcgcttagcaatgagtttttcggtggaataatatgccttggcttcaagagtcccgaataaaaggcttttcacgtcccgaaaccaggggtgtaggaacatgaaggtggtgtcacacagccgacaaagcagggcgatagcagcgatgctttgagctgtgtatggcatcagggacccaaatttttgaagaaaggtaacaaaaatg

SEQ ID NO: 8098 - DNA, 700 bp, Nannochloropsis_gaditana
gtgcaccgttgctgcgggccagaagtctcgtgcaagtcaacgggctctgtgtccttgtctgaaaaaggatgcggcagcgagatgctcctggggagcagagggcagcaccaaaatcttccatgtcatggtgcgtctcatccatcgcaggattattatcggacggaagaggatgcggaaagggttgggaacacatttgagaacgagaaaatggattgttcgcctgcttgagtgtggaaagcgggcgctctcaatgatgtacattggtgaatcgtatgtggttacatatgaatggatggcggattttatttaatgacgtctttgatttatgagaaatgagggccaaaattgaaagaaattatcagaattatgtttcaatgttatttagctaccttttaacgacacgatttctacaattctttacacgcctgagtcagtacttttccggaaatttccttgattaagaatgatgagcaagtcaagcaagccatgctacatcttatcgaatcatattatactgattgtgcatgagcaaaatctcgaacacccgatactctctttcctttctgacatttcacggggttgaagattaacttccatctctgctcgaattttaacggcttgcactgcttcgatcattttttttgcactccacgcctttattcattacacaccgatataaattgtacattataaacagatg

SEQ ID NO: 8099 - DNA, 700 bp, Nannochloropsis_gaditana
gggtacctagatcatcacatcatcaagctcagccgcccccctccgcgcccgggtttctcaactatagatagcgaaaaaagaagaaaagtctacgagacgtgaaagtgcgcgggtgacagaaagaaggggtggacgagtaagagtgactggtttgtcagcacaggcatcgtgtcccggcatttcggcgctaccactgtaggctcttgtggtctgtgcagcgcaggaaatctcgtgtgcggcgcttctcagtatttatcctcagccctctcttcattccccttcttcgctctcacaggccgtcatgccgcatggaagcacatgataaattgcccagaattcacacgtaaagaggcaggccaggtcgtgggcgcgtctatttaagcgacctgagatttgcctcgaaagccccgactcgcgcgctcgcagaagggaggagctgcggaggaagggcccccggttcggttgagggagggaattatattccaaccaaggagcgtatccccaaagattcttagtaaggggtcacatagaaggtactggggggatgacgggggaagtaggtcagaaatgtttgacttgtgtccatttttctggcacgagaaccagtgcccagggacctcggggatctgatggcttctttcttcctccttattggctgctctacctccccacgcgcatcacagcaacggaaacccccatg

SEQ ID NO: 8100 - DNA, 700 bp, Nannochloropsis_gaditana
cctaaccatgcacgcacgcgacggagtggaggactaggtcgagtctccctggagaggggaacaaaggaagctaatgcaaagtcggcagtttaaagggaagtacagaaaggatatgagcgattgctcatcaaaactgttgctttatatttatggtgacgaatgcctttttgggagtcggattttatgctttttaactttagtgagctttggcgggggctctcacctttgtgttggggggtacgctgtcgataccttagtataaagcaccattcgaatgtaattgtaggccatgagcttttcacgcaatacaaagcaatggatgtgataagttgaatcgtatgcatgtatttgcactgagacgtgtgggaacaatcaacttctctctctaggttttctcgttcgtaagtgagtcaagcgatggcttcgatgaagtgcatgatcgtggctttgcaaaaccctcttccaaaaacattcgaatacgccatacagcgaatgagtagccacattatttctgtttttcgtttaacgccatcaactgggtgtctatagtaatctttgctttctaaaaatctcaattctcatttcggccgtgtggttttaagtagacagctgccacaacgtaccacattaagccccaaggcgagcggtaaattttggcaaaagctcatgcataaggactattttaccaccctcctacacg

SEQ ID NO: 8101 - DNA, 700 bp, Nannochloropsis_gaditana
  misc_feature (567)..(576): n is a, c, g, or t
cctctccaaccctctctccctcgtccctcttccccctcctccaggcatctctccgggagacacttataaaggaatacggggaataccctccggaggcatacatggagacctttcgatccgttcgacaggaatggatgaacaggtaggaaggggggaaagggagggagggaaggagggaggggggaaggaaggtgaacgagggagagaagaaggaaggaaagcagtatgcttgccgtcgttctttctccctcctttctcgcttccttggaagctttttgtccgtggttctggtttgaaattttcctttctgcccgcctctctccctccctccctccctccctccctccctttcttccccttcttccaattcctctcggacttctgagtccaaagagaagacatgactgaatgtgcattagcttggcgattgaacacgtctgtctctccctccttctctccttcctgccctccctccctcttgccctccttccttccctccttcccacccttcctccctcccgccctccttcccttcctccagggacgagagcggttggttgggtgccnnnnnnnnnncctccctccctcccccctgcctttggcagccctccccatcctcctgcatcaacccctcccagtggactcgcggcaggtctcgcacgcctccatcatgtcctcggtggcacccagcgggcgggag

SEQ ID NO: 8102 - DNA, 700 bp, Nannochloropsis_gaditana
  misc_feature (634)..(643): n is a, c, g, or t
cgagaaagggcgaattccaccgaatccacctgctgcgtccctccctccacccctctcctcttgagctcctgtctggaaagctcttcgatggaagcagccctggattcggacgaggacagggtggaggaagggaagggagggagggaggctggaagagacaacacggaggaggaggagaaggaggaggaggaggaagaggaagtggaggggtgggagggagagctgtcttcggaggaagaggagggcagggaagtaaaacggggcaacaggcgacgcagacgacatcgagctcggcgacgctcgaatggaagggggggaagcagggagagagggagggggggagggagcccggttcctctatacacgaccacccgcttgcctcagtccatgtcgccgcgtcccgtgggagaggattcggctttctctccaagagccagactttcttggcaggatcacggaggcagcagcggcttgggagaggacggagtgtgtttccctttgcccgaccggtgggagggagggaaagaggaaggggaagaggggagggaggaggaatcgctgatgatgacgacggccatgctccctcccaccccgtcagcggtctcggccgtcgttgcggcctctcgattcctcnnnnnnnnnntttcaactccttactttcaccctctccctcgtccatctcgccctggacgacaccatg

SEQ ID NO: 8103 - DNA, 700 bp, Nannochloropsis_gaditana
tcactacgctgggatttcgcggaatgaccatatgttgatcaagtcacgcggcttgtccggcctgtgcggctttgtatatattcgtgacacgtcacaccctgtgttcagaagtctgtctcgccccggcggcgaagcaacccctctcgtcgaattctcttctgatggagacgtggcgtctaggcatcgtcatcactaggtacagcatgcatgagagtatgcaagtgcaccctctttccgcgcggtgtatgtatttgtagctgtctgaacgtaatggattggaaacttattacaacaagcatccaacctcctcatccgcgaagcccgtctccggccgcagggcaaaacatacgttttcaattatttctcatgcatcgttgccaagttatggctcgtccatccttcaataattgagtttttacatgcacgtacaagaattgtggtgaccattcggctattcggtgaattgtctgtccacttccactccattaccttggatcacaacacggatatgggccgctagggttcctgtcattaccgtacgtctttgtggcataccacgttcatccacacagccacaaagatatcaacttcctgtggcataagccttacgaaaagtgtctttcaagctcgtaatgagattacggacgctcaattctgtttgttctttttctagcacgaaggccccggcaccaacaccatg

SEQ ID NO: 8104 - DNA, 700 bp, Nannochloropsis_gaditana
  misc_feature (685)..(694): n is a, c, g, or t
catggcaaacaacaagtggcacttcactcaagatgatggtctctttagcctttattcctgcattcaatatccatgtgggggctttctctcgcgtgaggtactcgagtcgtcctgtaaaagtaggtgacagttgaaatcctgcagggaacgtacctttctcaaagagaaatcaatacttgccaagtctgcttctttccacgtaatgcgcactgttttcgtccaacatgatttgtaggctggtttctctacctaccaaggtcttgatccggacagagccaaagatgtgctcaaaaaggcgcaggtgagtgcaaggataacgaagcgatggatgagggggcgaatgcaagtaggaggtaggctgtgtttgacctcattttatcccctttttcattttctcttcctggaacgtaggcagtttgtttcgacgtagactccaccgtgtgtgcagaagagggcatcgacgtcctcgcggcattcctcgggcaagggcaggcggtggcggatttgaccgcgaagtaggcagagggaaagcagggagaccaggacgttcccttgtgatgaaatattttgtaaatatactgcagccattctgttttcctgtcggcatttcggaacgtcgaaaattcgaggtccttccacgctcgatcctcacggttccctctcccctctcccttcttttctctcnnnnnnnnnncagatg

SEQ ID NO: 8105 - DNA, 700 bp, Nannochloropsis_gaditana
acgtccgctttattattttacgtgttatttatttttggtgtcaaatttatttcattttaacctcctccctcgtcgctcttcccgcctgcaagatccgggcgaggggactgccgtcttgacttcatgtgatgcggcagtgacaccacccggaaagccaagggacatgcctcaaaaacacttaataagatgcctgcggtctggtagcccttcaaggagtttttgttttgtagcatgcgtgactttgtcccttagagtaatagagtatccgtacaggcaacagggacaagctttctcccatatcatcatcaaaaccgtgacacctatccttccctgatctacaggactttcccccctgaatgcgactgaatgccctcctacttttctttcgacttcagcctgccgtcttttctttgctcgtcggagttcaggcgtctgcactttagtgttcagggttcctcctcgcccatttcgacctcctccgagagctgggagctccggcaaaagcaagagcgacagcgtcgacaggagtggcaggagcgggaagaacgagcccttcggaaagataaagaggaaggggacgacggcagcaagacctttttatttttaaaaggtcggaataaagagtaaggcgaacagaaccagacgcagtgagcaactacttcgacttctagcgacgtcgagaaaacgaattaaaaacatg

SEQ ID NO: 8106 - DNA, 700 bp, Nannochloropsis_gaditana
aatcggggaaaaaagttactttccagacacatgccttcagaccactccaataatctggccacactgctaaacgttgcgagggtcctgcatgacaatgcggtcggggcgtgcgtacgacggggaatggtggtacataccccttttttttttctgcttttctgtcgggcggaaccgatcgcgagaaaaacggacaaaatttcagaatttcccccaaagatgacacacttccgtgaccacaacgtatgcctttcggtatcacaaccgagttccctgcctcccaaatcttggggcaacgcatttgtccccgactgaagtccagtggatggcattggcgcgtttctatccatgccgatggtcatcccccttcgtttgtggtctttctgacgcgtgcatttccccccctgtatgtctctgcttaaatataagacgtattcccatcccgcctgtcactcggcggtcgctgacagaggtgctggcgtcgcttgcccattccaacttcacaccattcgtgacccgaacgggatgaccgtcctctagtcactttttaatgcaatctcgagacattgacacacgacgtggtgttgacagtcggcacaaagccgttcaattagcttatgattcggtgccaccccgccgtctttttcttccaacctcataaaggccctgacccttcgactcgcaataaccgccctcgtcacag

SEQ ID NO: 8107 - DNA, 700 bp, Nannochloropsis_gaditana
attggaggtcatgcgtaggaaaaaaatagaagagagagatgacgaagtgaattccatagaggaagataagggggcagaggggaggaaatcaaatgcaagagaggagcttgtccttcgcgtcggcgtcagcgaggggaagcatcgtatggttcgacgtcttttggccaacgcgggttatccagtcgtagcattgcatcgcgttaggtacgggcacatatctctgggaacgttgtcggagggggaggtgacggaaatagaagctcagagcgaagggggacagtgggcccggagattgctaggaagctgacatggcataccatctaatcgataaataaagcatcaaaatagcacaatgtgcacatttgtacagtggaaataatccgtgcaatgccctcatttaacgacttggggcgccctctgaccgggcaagatgggccgagaagaagaaaggatcgccacgggcgcctccatcttcaattgcttccacccctgggaaaggaagcaaaaccgaaatgacatcccaagcaccttctccaagcgcgtgtatgtatcttattctgacaattcatttgtttgtggcatgagtagttctcatcgtctcgattctgtcacgctttctccgccgtcatgacagctgaggtagctgcctgctgctgtgactgagcattcatcgtgcccctagactaggggaagcgatatg

SEQ ID NO: 8108 - DNA, 700 bp, Nannochloropsis_gaditana
taaccagggcggcaaacgccaggaggaggactgacaactcctgggccctccatgggtgccttctcatctttctctatatgtgttcagggaaaagcatgtgggatgggacattgtggggcaaacgtaagtgtaagcactccatatgcactcaggctagcacatcagatctgcatccagttcacggggaccgatcaagcggctcgagaagccggggtcccaaaaaacaatcaaggagtgcgacaggtatccgtcatgtagaattcacattgccatgtggtatttgatgtggcttatacagcccaagcttcagagtgtgcatgttaaagatgaagctacggtctgtggctcctgaacggcttgagattccagccataaaaccaaaaatcgacaccactgagcgctccatcagaccgtgatgctatgatctcaaacatgagggcatttcatcttcctgatatgacatcgcggagatcatgcgcttgtcttttggcccgcgtatttgatccaaccgacgcggctggagggacgacgatcgctccggcccccgccagccctgggctcgagccgtgcgcattacccgtatcccctttttttttctttcaaaaaatgaactttacactgccatcttaccgtggtccgactgtgcatttaccaaccactcacatctctcaggtaaaaaataagttttgacgctgcaatg

SEQ ID NO: 8109 - DNA, 700 bp, Nannochloropsis_gaditana
aggcgtggctcgcatgaaccttgggctgctcgaggaggccaaggcagacttattgggggcggcgaaggtcgaccctcagaacaaggatatccgaatgcaggtagggaaagagggagggaaggagggagggatgaagggtaggagacgagacttccaatgagattgagggaggggcagggaggagggagggcggaaatgagggaggggagcaagcggagccttacggccgttacagtgtcgagggaggcgaggccgcttctgaaaggttttgacttagtgtttctctccctcacgcccctgcctgtttccctcccaccccacccggtgccctccccttctctttttctcagttgcaagccatcaaagacaaaatgaaggccatgctcgccaaggagaaggctacctttggagggtacgtgcgaggcgtgggagggggggacggatgacaggagggaggggtaagatgtaagaccgcgatatatcgcggaagctcgtcggggctgacagggagggacgaaggaaggaggggtgcgagaacgggtgaaagaagtgggtgaaaaagggaaacgagaggacacgccttttctcgctccacgagtcatagtataccccatggctgtcgcacggctccgcaccctatcttatccctcctctcctgtctgccttcgtcccggccagtttcttgaataaactctccatg

SEQ ID NO: 8110 - DNA, 700 bp, Nannochloropsis_gaditana
  misc_feature (5)..(626): n is a, c, g, or t
ttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaactccctcgttctcccctccttacttccatcccgcccttttcccccgcatcgacccccacaggatttcatg

SEQ ID NO: 8111 - DNA, 700 bp, Nannochloropsis_gaditana
gcctcaaaactcctgcaccccaactcctgcacccgttaaagagtggcgcatatgaggaaaaatcagacaaccgcaatacattctcttgtatcagaagactgctatatgtagagaaggccgtgtgggcctgaaggcatctatgttatgtcaacgcaagcttcgacttaccgagcctctcttcccttggtccaagcaacaatatccgtccgcgcctccaaaggggcgtactcgcgagcaggcaaaaccacgtcggacttctttcccataggatactgtagtgatagaggagttgcagaggattggaataccaaacagggcaatatgaggatgctcgttgccgaggggacctaggacgggcaagaaggctcagagagagtccatccccacctcgttttaagattcacttccaccgcggtgcggtcaccgcccagcccacgagatgccatacgagtcacaccaggcggaggtccggtcatcttcgagtaaaggaaaggatccttcgtgttcctaggcaacaacattcacacctcgtcctcgcctcgctcccccacttccagctctctcgccctcctcagtcctctcagctctgtctctgctttacatggcagttttcgagtctcacaccttcatgtccatttttaatcattcgtgacagggtcgtagaaataagtaaaggttttgttccacacgttcaggaatg

SEQ ID NO: 8112 - DNA, 700 bp, Nannochloropsis_gaditana
aagcccgctctgtcttccggactgctttcatccagaccatttatgtcaaaccatcccggcatcggaaagcctccattcaaggtgatgggccgggtgggtgcggtgggaaagatcatgcgggtggtggggaatactttaggatcaaaggccccggcccacccttcgccggagtcgcctaggccgtgcatccaaatgatggaggactgagcaggcccgcctacagggttgagggttataccagccccgccaacgttatcgttacgagacgctctgtgggtcatggcagcgagcccgcgcgtacgtgtatcggcagggaaagtgctggtcgggtacgcaaaagcggtacttttcgctgtggccaagatgctggagacagagaggcagatagcacggcgggcgctccagggcaaggggaggctcatgcactaagaaagaggtaaaggacaccctgtcaattttcagatgttgtgcagactccagtaagttcggggcatgacacgtaacaacacgtgcatgacatgtaatggaataaagtgacgactgggagcatacgaagtactcagcacgctctgtctctctcggctgtcgcggaatcgccgtctcgaacatgcaagaaatgcaacaaccaaggcactgactgaccttcagaaattgaacatttgcaggaatggtctggcgcaccatgccacccgcaaacatg

SEQ ID NO: 8113 - DNA, 700 bp, Nannochloropsis_gaditana
tgctgcacctgagcggagacgctcgctacacgtggtgccacggaatacgcccaggggtaacgcagtctcagatcagcgatttcaatctggggggggtgatgtcagacgagatggagggagtcgaccaggaggctgtgaggacgctggaggggttgccactctgggattggtggggttctatgaaaaatttgcggcgtcgaggcccggagcgtgtgagcatcatttttgcgttcgcagacccagaatgaggtagcaaggaggtcgcggtaaattttgagggggaaatgaagacgattttgtagctcttgcctggatcactcgagtgagccgcattttctttccaattacttttcgaatacagctacgacgaaaaaaaactcattttcagatcgtgggacatttaacgactcttatgggcttgacgagctttgctgtggggagtgagctgcaaattcttaggtcgagagtctcccctggataaacctacccggttccttgatccttcccatgttccgtgttatctcgtgtttgacaagcccgtaacacaggcttgacatgcagtgcaacttttgcggaaggatacgtaagctatatgctaataattcacttccctatgaatactgcattttggaaaatacaatgcacacaggttcacagcgcagtaccaaaaggtacaacctcctgctctcgtcttcggatg

SEQ ID NO: 8114 - DNA, 700 bp, Nannochloropsis_gaditana
agcgtgttcgtgaagaggcctgcccttagactgcatttgtcttttgcacaagcagtaagtgaaggagcaggaatgggaaggcttcaagctactatgtcgacaagcgacgtccagtgttcggataggcatatcttttagcgtgggaaatgtcgcgtggttgagaaatatttcatgttgatgtgtgcgttgggagagggccctctttccattcgtaaaagcaggacgaaagcaatagagcggggggttatagagctagcagcacaatgcgagcggacgcgcttattcggtcgttgcggtccagcactttgattgcgctcacggacagataaccaggtaaaggcggggaatttgtacgaatcatcacatctattttacctgtattctacttttgattctattgggatcagtaatgggactgcaatcacttttgtgtacttttgtcccggtgcttttcatgattctctttgtcttcctaccgaggggcaggcccccactgcagacgagctgaagttgacaaaggacacctcaatgtgagtccgggcacgtgctctgaatggtatctattcaaccattctttccaactataaattttgaacatacagtctgaggccattacgatctttgggtaagatttccatctttactttaaaaagattctgcgggatccgtcattcagccctcgactccgacgaccattatg

SEQ ID NO: 8115 - DNA, 700 bp, Nannochloropsis_gaditana
  misc_feature (1)..(527): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagggagggagggagggagggacaggaggggaaagagaaccgctaaggttttccagaggattcttggcgctgccactcgggattttgattcctggtgactgccctctttccggtaccttaccctcctctcttatttccttctcccaccccctaggctgggactggaacatg

SEQ ID NO: 8116 - DNA, 700 bp, Nannochloropsis_gaditana
gagtaggaagctgctaacctccgggcggcagccaggcgccgtcgttcattccactgaatcttttcactgtttgctgggaagtcggcctttgaagcatgttgcattgaccttttcccggcatccaacagtttgatgatgctctccaataaagggcttaagaaaaaatgagcggagatccggcagagatcgagaacacgagaaaagctgaggaaaagctatcaccgcagcaatgtactgtccactatgtcagctcctcaagcagccttgtaaaacattaaattgcctcgattttatgtttgaaatccaatgacactattccctgcacgcagaaaggtcagagggagaggcataaaacatgtcaagacgcttgagaacgtgagctcgtgcttagctcagaattctcgataacaacctaaggaaagacacgtatgaaaaaagaaagtaatgcaaatattttcgcatgcatcgttgtctcaaatcataatcatgggaaaaaattcatcacagagatgattaaaaaaattccctgaaaacacgcgaaaatttttatgctcatccccccaccccaaacagcgagcgagacgcaacacgacttacaaagtaaaaccccacaaaaatcgcccgcgctaaagttgtaccgcaacatctcaaacgcttgcgaagcgttcttacctgaccattaatgtgcactatttttagg

SEQ ID NO: 8117 - DNA, 3 bp, Nannochloropsis_gaditana
ggg

SEQ ID NO: 8118 - DNA, 700 bp, Nannochloropsis_gaditana; identical to SEQ ID NO: 4668

SEQ ID NO: 8119 - DNA, 700 bp, Nannochloropsis_gaditana
ctggcgagaggcactgtactgcctgggcctgtctgcgcactccgacacaggcgtccgccgatctgccgtgacagttttgccgagaagagagtaagctgtgctcgacgacgctggtttgctgagagtagactgtgggaaaggaaggaagggggggaagctgagggtgagtgggcggagaggtggactggatatgaaaggatatgtctgaaaggtaggaatgcaacgccagtgaaaacggaaacaaacaaaaagagcgcgtggctgtcagacagatagagaaataccctcgctggatgcgtttgtgcgggcttagtatcgtacatacgaggaagaacgataaaaagagacctcaaagatggccgcctgcaccatccatatcactgcaacactccaccacgccatccacccatcgacctcgcccacccataccaccgcacagtccaagaccgcttcacacccacgccgtacattctcgcccgtcccttttacgccccctgccccccaaagcgcccaactcatgtggtttccggcgcctgtgtggcttccctccaagctcgcgggccttcaagccgagtcatatttgaacagatcggaacggtcccctcttccaccccctccctcctccttcaaggccaccgcctttggctctttccgagcctccacctcatgtatttcgtccgccaatgtcagcacaggtatg

SEQ ID NO: 8120 - DNA, 700 bp, Nannochloropsis_gaditana
atgagccctacatatgagggaatatacatttgataccctcaagcgtatacatatcatagataagcctggaaatgaaaactggcatctcattttcgggacgaggaggtattattgagggaggttcagtgatgcaaatctcctgatgcctcggagatctgcgtatctctttctaatttctcctttcccttacctctacttttccgaacctcactcattttgcaatatatatacacacatgtatgtgtgtgtgtgtgtgtgtgtgtgtgtgtgtgtgtgtaaaagtcacacgtttatgcggacacattactcaagtgctgagtaacggcttcgtaacggcttgcaacggttgaaaggaaattatccaatcagattatagacacattttccaatgcatcatgcagggataagaacgtgagtggaacactgcagaaatgagtcatgcgtcatgtgtttaaaaagtactctgatgacaccctcgtgcatcaaatttgggaggaaattcttgtttatatttcttttatatgattcacaccaccacaggcaatggtcacaagagactatttgtaggactgataaggtttattagtctggcaacttcatcctatgcataagctgcccgtgattgggcgtcaattttccatcacctacatgctttgaagcgaacacaagagtcaagatgaagcgcgagaaaggagccaaa

SEQ ID NO: 8121 - DNA, 700 bp, Nannochloropsis_gaditana
atcggtataatgcaaacatggctaccgaggagaatgcactcaaagtgatgatcgctgatcatgggtacccgtaacctgcacagaagactcgctcatacagtacggaagatgcgaggcatggcttctctgcagcagaatatcacatactccgaattcaaccagccctcgtgctctatatttgactttaaaatatttaattttcccacagctatgtatcgagaagcgtcctttatgcaatcttgcaggaccatcaaaggagacattccgtgcggagcgcgccgttacacagccctaagccgtcgaggccaagcttcaaactaatttgccgtttcgagcagtggccagctctatcaaattttgcacttgctacttctatgacaccagcttgtacttttgcatgtgaggcggtagtgcatttctacttgagtctttcaaattaatgctttcgcggttaacggctgacttgaagtttgtgatggaatgtgcaccctcacctatcgcatgtatgttgaattagtgtggtatatcaaggtccacgctatttcgcttcttcacgagaatcaaagttcacgacactgagatccttctacgcttaaagtactatatggcaggctctggttaggtgcgccttcactgagcatagcatgactcacgccgcagattttcttcacttcccgcattcaggcccaggcccagaatg

SEQ ID NO: 8122 - DNA, 700 bp, Nannochloropsis_gaditana
tcagaagcaaaacaacctatattctattgtttttatttgaaacattagatactatgtatatttttcttttgccgctctttggtgcacatccgctgccatcatgtcttgaatcttggcctgccctcctaatatcacatatgcagaaggataattggcttacttgcatctcgcacctttattttaagaacctatcgagctcactcatcacactagctatgagaaggaggtacatttggggaaattttccatcaagaaattactgaaattctgaaaaatgagtcatctgagttccttgtacatcggaccataaatgtttttgataacgtacattgcaaagaaaaaggcaaactctgcacgttggaacatctctctttccggaaagtctttcatcctcgttaaagataatttcggatggtttatcgtgtgacaagacccattcgggagcctcgttgaaaataaatccctctgacgtcatgcgtcctctaacctcccctcggatgtcgcgaaggtcgttgcagtcccagtgaagacatacatcggaaaaacactctttatttcgagcaccccttgctggcatttcccttgtctttggggcccaaagcttgccttagcacgatcgacattacttgacactcaatttcgcattcaggaacctacagcatcaaggagcattcaaagggcggtaaacacactgacgatg

SEQ ID NO: 8123 - DNA, 700 bp, Nannochloropsis_gaditana
gacttctgcttcttgggcggtgggtgtggggtcgatccagtcgccagggacaggatgtggtggagcgcgtgaccaacaagtgctgtgacgggcacggacgcccacgaaatgtcagtattacagcatagcattgaacaggggggcaatcagatattacaatttatcatagctgcgaaagcaaacgttacagccgagacgagtggagcggggaggtgattgaattgggggggtaagatccaattagaataaaagacgaggtaagtacagcgtaccttttccgtctgtctgctcttgtatgtgtcgtaacatcgaatagagctgactacgagtcaaatcttgtggaagcggaggcgagggtgactgaaaaggaagatgagcatcttgatccagtccagtgcaagactcaggcgctgggccctccacgtgcccctgggcggtcttcatgcacccctgtgcggtgaaggcgcgagacttaatatttatacagggggaaggcatgttttgtccgggtatatgacttaggcgtgtgatttgtggtagatcctaggattaaaaggggcctcccctcgaccctgcctgcttgagaaatcgtgttgccgttgcgcaccgatgtcgcgcttttggtgttgaatttcacgcgacaccaatcccacttgttcaacctatggatgcaaacataatctctcacaccacagacatg

SEQ ID NO: 8124 - DNA, 700 bp, Nannochloropsis_gaditana
tccgagcaagtcgaccagttcgtacacctcattaggatcctgctgagagaaaattatgttgtgctcgtccatgtcgacgcttgctagtgaatcttgaagttagcagcaccctacataagaaagagagggtgagagaaggtacctgcgaatggcaacgcgtgaagagtgcgacttacaatagtaatggccttgacttctcagccgaaatgggcccccggcccaacgcttcttctgcccttgcctttccaggttagagccttgaaaccagcctgaaaaagatgcattgtcattttggaacgatgagagattggtcagagggtgccagcggcgtgactccgtgtaacttttacattactttaatttgtttgcgaggatctagcggcccacacccacttcaaggaagggaggacgagagggaaggcccgagacatgcggttgcatgacatgcaggaaatcccgcagtatgacaacagcatgaacctcggaggcacagggataaagaggctcacatggaggattggatgttgtttccagagcctcattcatctatttttcgcggccgtgtcggtcacgacatcccgacacatgctttactcgcccgaaaaccaggggaggcttcgttcggtttgtcttctcccctgcccccgatggcattttggccattatcaaaaaattgtacggactgtgacgcctcaacatg

SEQ ID NO: 8125 - DNA, 700 bp, Nannochloropsis_gaditana
catgctctcgtcaactccaagtgcaacccgcgcaagactcacgggtgaagtgggtgttcttgcatccggatgggcctgggcttgcactgcaggcgacatatggtgtcttaaatgacttcaacacccgccgggagagggagctaacaggcaaccagatgccctcctaagtcaggcccgaaagtgtcgtgcgtgccctccccagaattcgacacgctgtaccgtgtgtacacagctactggtgttccatccggtggagtcatggggaacacctctccgggaccgggctgaattttgggggaataatatttgagcttgggaccatctgctctcttcgcgagcttctccagcgttttccttgcatttcaagcagcacttcaacagtcaattacaccaaacacagaaccctggcatacacgaagttacaggcagatttttgagatgttatgctttttgaggtgtgctgtgtgctcaccccccccacctcttgccttttctaccttttcccgacacagcatttcgcgttttcgatctgcggattgttctgctttcccccctgcagacgatgtcattacgctgctacatttcaagccggtcaagaagactacaatcaattatcgtctctctcctaccatgcctgttagtaacgagaagcgtgcaagcattagtgacagcgccatctcttcgaagaggtccaggcatg

SEQ ID NO: 8126 - DNA, 195 bp, Nannochloropsis_gaditana
ttacgcactggcgcgcagaaggtcaagcggcaggctacactgtgcactgtcattgccctgattttatacggcgaacacagacaagccgcacactcacgccaccatcacgaccttgggaacagctccaagctcgctattgggcgcacagtgcccacatactgcttcgcaacacaaaatgggagctgtgcaatcatg

SEQ ID NO: 8127 - DNA, 700 bp, Nannochloropsis_gaditana; identical to SEQ ID NO: 5950

SEQ ID NO: 8128 - DNA, 700 bp, Nannochloropsis_gaditana
ggccgcttagggtattgtggaggcctcaagtggggagagaaggcggcggacgggttgaataggatttttttgttttgtttgcgaagcactgctttttaaaaactgacaaaggagaggatcgcattcgaggtcgccatggccccattttaaccttcctgttcttccttctcacaaaagtcccaccctatacaatcgtatcccacaaaattggcaggtgaaaagaataaacaggactggaagtgcaacaaggtcagctcgacgttcggtagtgtccaatttctattatcatctttctttctgctgcttcttgcagagcagtcggcactcgagcagtgggccgcgcttttaattgtatatcttgacccttgcatcaatcggcatgggaggcttgttgtcgcgggtcctggacacgctgtccgcgctgggagggaagcaggaaaagcgaattctgtaagtggatggtcacgcagggaagcaagcgaaaaacgtgtcatgggtaaagatgtttcaatgggcatctcaagcttttcctgcacatgtgtggagcgtgcaacgaaccatataagacttataaagtggaggaaagggccatgcaaaagcatcgccgggcaggtgccctctggatgtaaaagcctccatgcccctgatctcacacacgtgctcggcactcccggccatcgatcaatccctgtgcaggatg

SEQ ID NO: 8129 - DNA, 700 bp, Nannochloropsis_gaditana
caagcttactaccctcctttccttgccagggcgtattttttttgcgagaaatataaagcgatgcattgatggcaagcagatgatgatgccactgaatgatatgaggcattacaagctacacataattattttgagtgggcttcagcttgtctctttacttcctcctctctctcgccctcctcttctaccttgcaaatcccctttagcgcacgctaaatcccaacaccattcgtcgttgagcacaagccgtagattaccacgtcgcctttagtaccttcaacgcaatcctcatccccctctgtcctccccaccatcatacgcctcctactccggttctacttctattggatcctttccttgcactgtttcgtccttctccttcctctgaagccagccccctcgacgcatcgccatggcgcaggagcagaaccaaaaccgtcaccgcacacattcaatccctctagccttccttccgctctggcggagagcctctcaccggcgtgccaatgacggcctccggggggttcgttccacgacattttttccctccctctccctccttctcctcttcgcgtcctcctgcttgacagcacacgccttcctccctcttccctgccggtttaagtttgctctcgcggcggtccccggccaccgacgagggctattgagcggcgctctgaacgatgtgacaggcgagatg

SEQ ID NO: 8130 - DNA, 700 bp, Nannochloropsis_gaditana
aagctgccgtacattctagatccagctcagtaatatatgtgatggagttaataattatttgtcgtagttttgccgaggtgtcatgaaaataccgagcctcagaagcgttgcttctcttgaagttgccctttcatagcacttcgtccttgttatgctgctatgttgagacaagtatgcatcagactcaacgttgtattttacgcactctctgtatagcacggaccataagggcttgctccaagtgtgtaattttgggcgagctttttaaggttcgattgcagttgttctttcgtcttaatgaaggcatccttattcttttgtttctcctattttacgtagctcttctctacactgccttaaaatcttgcctaaccttacatatttaatagctgaaatatctgaagttttcgattttccctccgagccgcgtgaggattgaaatgcgctgcttagacagatcacgtactctaggtctagcagcgttccttctcattttattccggtatggtcatgcacagcgtctacgcgtggcagtgttaagcgacgcaaaaggttcgtcgatgttaaattagaatgtacgcacattatcgcatggtagagcgttgaagcccgtctagaaactaacttcagccttgttcgtacgttgacgttcaatttcgtctgcatggaatttcattcgcccgcacattatgtgcagatg

SEQ ID NO: 8131 - DNA, 700 bp, Nannochloropsis_gaditana
gtgcgcccctcctatagcttggaggtgcccggaaaggccgagaggaatggagggacggaagaagccgtcgggcacggtgcggcggctctggtctggtgtttcctggtaggcgcagaggaatgggtggctaggaagggaggtcagagcaggggaaccgaaggagggacggaagcaaagccgaaagtgccactgtggggcggagccgtctatgtcttggcggtggtggcgtcggcgtggcccttggtggcggccgggggtgacggcgaggtgggagacgtgcgacggtaagggatgtttattgaggttgcagtccctccactttcggtttgccttttcctgacaggggcttttgtctctttgttctcattttgttcgccatgaatgttgagctttcccggtctttcagctttcacttttgacgcgtcgtaaccgtcgaccatgctctttatccctccttctctcctcccttcttcgcagcctcttctcctacgtctcaacctggaacgtgcttctcctcctcttcgtcctcctccccctcgtcgtgcacgctgcgctttaccctctttccctccctccctccctcacggcctcgcctctttcccccttcccccccgagggacgcgcctccctcctctcctatactcttttcacctggttcgaacccgtgattcgcaaggggtggtgtcgagatttaaacatg

SEQ ID NO: 8132 - DNA, 700 bp, Nannochloropsis_gaditana
agatatcaggtcctgtagagttgagcaggactcaagcagcgtggcaacatcggctatcggtatcgtctgtgcttcgatagaagtgcgcaaggcatgtccttgaagtgtgtatagaagacacgtgacctgaagagaggctagtagatccttgtagcattgtgtaaccggtttgagtgctgctacagcggggtcattaagggggggcaggattggttgatgcgacatccgaagtgaaactcgctacttttcggggtacttacgcgtcctataaccacagataggtagaggggaaaaataatattagcttcaaagcaacctgtcagcccgtatgcaaacgtgaaaccgcctgattagtttttcggaggggcggcagacatgttagcagcaccgagaaacgaagaaggatgatgacgtactacttccaggcaacggccccggaggtggattaagccggtcactcatgaattcaataaagtgcaaccacacggccacaactcgatgagctgaaccatggattggaaagttgcttcaattttcattggagaggcctcgatgtccgagtttgagatgcatttaaagttgatttctacctcttttttataccatgatctgcatccatctcgcccatttttcctgcccaattcttatttgcgttacacattatcaatcgatgaggtaggacccaggatttcaaaccatg

SEQ ID NO: 8133 - DNA, 700 bp, Nannochloropsis_gaditana
gggctcaaagcctcccaagattttatttcattcacacaaagcatggcacgcacacacgcatgaccgccatgaaaagggcagcgagactcggtcgcggttcaaaggaccgcgcatttcgaccgtaagtctacagtgaccaatgtaaaaaatgagcacagacacgggcgtgtcacaggcattgcgtcccaagcttttggttcgttcgcgcaatttttggttttcctccccccccaaaggtagtttgtaatgtattgccagcctaaggacacggattgtctcctttgtatcaaggttgcatgcggtaatgttggtcatcgaagatgccatgccactttcttgtgaaggcgattgagaaagattttttggggggtaaatttctggcttgcaagctccttgcgtttattttttttacttccacgcgtcagacgacaaatggggactcgttgatcttttgcacgctatgctctggcctgagggcacgtgatacttcgtccagtggtatgaatatgtgacatttcacacagcactggtatttaaaaggcattgaggaccatatttcgtgattaagccaaagtgctgaaagacgttatgtcatcctttgcttgaaaacctaccgtgccatacttcgcgagggctcacccacaatcatgttgtgcacacaacgacttttcttaacatgggttacaggacccgcactatg

SEQ ID NO: 8134 - DNA, 700 bp, Nannochloropsis_gaditana; identical to SEQ ID NO: 5749

SEQ ID NO: 8135 - DNA, 533 bp, Nannochloropsis_gaditana
agtggaagcacggtacggagggagggagggaagggaggaaggaagggaggggcggggggggagaacgcagccccgttgctcaccaggcgtccctcgttctccctacaggccctcccaaaatcgccatcgtccccctgggcaccggcaacgatatcgcccgagtcttggactggaatcttggtacgccccctccttcttcccgcccactgagccgctcttgcccttgttcctcctcacgtgccgatctttccctctcccgtcctccctccctccctccctccctgcttccttcctctttctctcactccctctcttcctccaggtcacgattggtcgggcggttacttcccatggagtaacgatgccgccgatgccaacctcctaagtacgcgttttccacacgcttctttctcctctcccaccttttggcacctcccttgtgatttaatattacatgcactgtgtgactattttgacgcgttcaatcctttctcttccctccaggcgtcttttcggacttgacccgcgccatg

SEQ ID NO: 8136 - DNA, 700 bp, Nannochloropsis_gaditana; identical to SEQ ID NO: 6300

SEQ ID NO: 8137 - DNA, 700 bp, Nannochloropsis_gaditana
gctcatcggtatttgaattgcgtcctcgtttccctcttgttcgttttctcaccgtggcggcgaaagcgacctcccccccctcacatgccgggacgcattacttcggggaaaaacttgttaaacgaatcgacattgacctttcagtacctttttagcccttgtacaggagcatctgcgttaggcgatggtgaacgagttctgctcatgcttagctcacctctgggagtcttcggaggaacacgagaggtcacaaaagcggggcggaggcgccgcgcggtccgtgaacatgacccgaggggacactggaaaaggcacagaggacgccacaactccccgagtcaagcatgacataaatatgagaggcagtcaagttcgtgtcaaggaactagcaaacggacggttccttataagcggtgcggggcttacgatcgcttccctgcctttggagcaaggtcagtacatgagcgcactttttccattcctttattaaaaggccacagctctgacatctcataagcaaacgtggtaaccatgatttccccctggcgcatacccgacaaataaacggctgaacgctttcccttcacccaaatttagactgtagcttttggcaggtgaaggtgctgcaaccaggccgcttcagtatgggagtttctcgcgcggccgaggcgagcgcactggaaggtatgaaagagcctct

SEQ ID NO: 8138 - DNA, 700 bp, Nannochloropsis_gaditana
ccctcgtagcaagcttacgtgtaaaagaaaatgggggctccaagccctccccaccacaactcgccgcagacgaagtagcgttgctggaaagtgagaccctcaaggttgttctccggatggtatgcaaaatggtcgatcggctgctcgaagtacctctctgagcaatcgcttatccctggtcgtgaggggtcatgggcggcaggcaaggcccagtgcgatgtcagacccccatggaagcgctgtgactgaacattgacacaggcaagcaatccatacatgaccacaaggatagacggatgccggttcatgactgggcgtattttgcgcatgtacgtgatggtagctaatgggccgaagacgttgttgttgccccccctttcactctcacgtcttaacgatgcaacttcagcgcgcaaaacgagatgttgtcgcctgtggatacatgggcatatctattatttcataaaattatgcaatttgataagacctaggtgccaatggaaacggcgctttgctcatcggtatttgaattgcgtcctcgtttccctcttgttcgttttctcaccgtggcggcgaaagcgacctcccccccctcacatgccgggacgcattacttcggggaaaaacttgttaaacgaatcgacattgacctttcagtacctttttagcccttgtacaggagcatctgcgttaggcgatg

SEQ ID NO: 8139 - DNA, 700 bp, Nannochloropsis_gaditana
acagtgagcctgtgcatgggtgttccgggcggtgtgtgagtgccatctcgcgtgatacgtgcgtgccatgaggagggaggttcctgcgcctcgcccgctcagtattggcgagcctccgggtcgctgtccgcaggcatgccgagtactggtcacatagccagtttttcggtcaggcggtgcagaggacacgtctgcaaagctgtagacggcaccaagggagtagattacatctgccgcaacgcgtccagaaaatcatctcggtggcagggcatcggctgtaatgctggaatgccactaccagcaaatgctttttacggatgagaatttgggaatgttccatcgccttcattcgcgtctgtaatacaaaaccatcgctacaggacgcacgagatgtaaaaccgcctgggtttaattatcgagtgtcgagtgcggatccctgcaaggatgccgctgttcttctagctcccgtacattgcgcactttatcgaagtagaacgctgctgatcccataccggatgcatgacgaggacttgattttacggaaggtgtgacatcggttgcaacgttcatgcattcctcatctttcataccgctgcgacaggattagaataaaatggagaggactttgcgtaagatgttcaagacatgcggatcgccgctgcctgcgttttggtgtggtgtcctcttggggttggcaatg

SEQ ID NO: 8140 - DNA, 700 bp, Nannochloropsis_gaditana
tttgttgccagctcttggtccgacgggtccttctcaaggcggtgcttgagtatgccgtccagcgtttcgaggcaccgcgaagccagcaagcggtaaacagcgaccaccaaagctgcccaatacacgtccaattcctcctcaccgagttcgcagttcttcggtttcagcaaatgctctgtagacgtgcgtttgtttgctctttgtcagtctggcaggaggcaggagcaaacgtccatttctagcacgcggaaacctttaaagaatattcggataagtcttgtctgtcccccctccccctatgcatgtcagagcaggtcccacaatgtccaccaacttactgagccccatcacatccagggcgtagcaaacgcgggccccttgctctgtaccggacacgtcttcgaagaatgcgatatccagaaaaggagctatggacacgagtgaggaatccttccccgcgtcttggctgggctcttcgtccacgcactctctagtctggtataaagcctgctcgaaacatgatacaacattgcgggcatcgtagtcattatcacctctttctcggacatcctcattgacaccagcggggcaatggtctaagtacatgaggtaaaggctccaagcccgttccgtcaatccgagccacgcctccagtcgattggggttgaatctcaggtctagaaaatgcatctgaagcagg

SEQ ID NO: 8141 - DNA, 700 bp, Nannochloropsis_gaditana
agtggacttgatatctcccaaacgcacggcttgctggagcagagccaccttgccgttcgcctgaacaggtgggagcagagacttaaaacggcaaattctgcgaacatttgcggtcgtgatgcatgataacaatcaacccaccttgatgtcttcgatgatctccattgcttgtgtccgggcaagagcctcgacgggctcgttgagtttggccaggtcatctacttcgctggccctcacgagccgcaagcgcggatgactgtccaccaccatggatctcctcgaatgatgctccacgaaaaaaaagtctcaaggccactgtcacgacgaatgcttgacataggtttcagagattggaaaaagactaagcaaatatgtagtcagagatcgcaaggcatgcctccatggagctccacctcccctcccccgggaagggcccttggcagtaagcatgccacgattgcttttcgtcctcattccgaaaaacaagcgaaagcttggctgggttagctttgcgctcacgagcgactttcgcttatgaagtatgatgtggcatcgatttgactttttggcgcgtttctttccgcaggctgaagacaaacacggtcgccgttggggcgcttgtggccctccgggagctcacgacgaggaggactgacgagtggagggctcggaagttaatttgcgctcaggtgtctatatg

SEQ ID NO: 8142 - DNA, 429 bp, Nannochloropsis_gaditana
tttccctgccctgccagaatttaaaatctgaaacggcgtgccggttcgccggaatcggagcacatccctccttgaaatgtcccaagcatgtgtgacaagttcagttatgcacccatatcataagttaataccgcaaataataagactaattgctaacacaatcaattatttcttttctgactccacctttgcaagattcacaggtctcggtgccaaccggagttgagtacgagatgcggacactttccaaagttttggctactaccacgattctggcaccctctctcgtattcggagacgtccaagatactttacatgaaactagacatcctgtatctgacgttatcctaaatggtaacaccaaagaagggcatcaagcgaaagcggtcgagacgctgaaattgcgcatcgacgaaagggggtgctatg

SEQ ID NO: 8143 - DNA, 700 bp, Nannochloropsis_gaditana
acattgcgaaccctgagctccttattcttgagtggtgcaggccatgactggagggggggccgaagatcaagctggaaacgggggagcgcctggctaatgccggaagggcgtgctttgggacaagtcggacgtgaaaggcttgaaggacgatggtgaagtgtgcagccacgccaagaacaaaccagccttggcgtgtcattaccttgccgtgctctgctcctgcatttatacatggatgcgatcaagtgaacgttataacagatgtggacaggacaggggaggctaacttgctgggaaaagggcaaaggaagaaaaaataatggaatggcctcaaccagttcacttggaaatgtccccacgccgctcctgacctcgttaccctttttatttatctccctcctgtcctttccttgtcaataaaacacgcaggctgtggggcaggtcgggttaattcagcgacttcaccagtcgcgtggaacaagtggaaaaagatctgcaagtaagctgaccttcaactctttttatgcgtccacgggctgccggggattgccgcggaaaaatgctaccggaccggttcggaggatgcctggtggtgcggcaaatactctgtgtaatgagctttcatgctttggctacaatgtgactcgacgtggtcataagtcggggtcttcaaccctaacacctccatcccttgaataca

SEQ ID NO: 8144 - DNA, 700 bp, Nannochloropsis_gaditana
aagcgagtcaagggccatgtgggggggcgactccaagaaaaagcaagttgaagttttgggaaacgtccttctcttctggtgttgacaggaaaaaggccatgcaagaagacgaacaaacgttgaattttgccacatgcgtgtcgtatgattctattcggtatggtagggtggtgtaggcttgcagggacacagagtttatgcagccgtgccttggcgtgtgatccttgtttgccttcctgatgagtcgtagctggtatagatttctcgcttactccattggaaaatacatgcacgccattgctatttgtaaaacccgttggccgtcttgtttgtctttataagtcccttttctgtgttacccattttttcttgtgtcgacctgtgcatcttgcgtgtcgaatcaaaggacaggcatgtcatttttggtgctggtccacctttgtgcgagatcggacctcctacccaactgttcttgactccgatcccgccatcactgagctttgccgatctgctcgaaattaaagcatccttaatacttacatgtggactttcatcagtgagaggtgtttatgctaaaaatactactgactagacagcacgcagtacccatgccttacaaattgatcgaaactatctcacattacatgtccatgaaatagccgttcccctttcgtaaaggtcgacgtcctttccaacaatg

SEQ ID NO: 8145 - DNA, 700 bp, Nannochloropsis_gaditana
tgtcggcccattcgacctccttgctttctcactctccttgagcggtttaaataccctcacaccgtacgtttgtaacatgtcaaacaatcgtttcttgcgagtaaatgagtgttcaggtgaatttgaggatgcgttcgaggcctatcgacaagccagacgccgagggggtagcaagacgctactagtagtgaggctactcgtgagatccaccctttacgtccacaaatgtgccgtcagaccgtcctcacataggtacgcacgtgcgtgtgggcaagcaaaacaggaataatacgccatgtgcgtcgcgtacgcttgccatcatggccgtggccgccggtctggcgtgcttttgcgggactgtttgtcgcgcgggcacagggtgtgatagaggaggctttagacacggagggcaagagtgttgatggccaacaacgcctttcatttgcggcgttccctcggtctgtccactgtttctttgccagcgttttcaatggtgttgggataatgattgtcggtgcgattgtagggcgcgtggtgaatgcttctaggggtctagggagtgaatttttcttcctggttttctgccatccattgctgccgccgcacgttcgatcgcctcaattcttttccctaccccgccccgcctacaatgcgcacaatttgacctaaatttctctctctctttcatattcacgtaggc

SEQ ID NO: 8146 - DNA, 700 bp, Nannochloropsis_gaditana; identical to SEQ ID NO: 4776

SEQ ID NO: 8147 - DNA, 700 bp, Nannochloropsis_gaditana
agaagcggtttacccgtgagcgaggcaggaacatgtgaagcaggcacatcgaatcccaggcacgatatgccggcgtttttgtctactgaaagaagcaaaaaattaaacgactgtgacggatattagtgccgtccatattgaagcttcaggtctttcttttctgtcattgcacttcgcttgggccagaaggctgtgctcgctttaacacggtattcaacatgtacttcttccgaaataagaggaaatgtgacttgtcttcttgtaaaaattgaatgagccagaaatgggagttccagtacagctctttgctgttttatgatgggatcttcaatgttacgtacaggtcctttttttttgtctcaatggacataaacgtttcaggagtactgaaaattgacgagagattaaatccatacttttgaattgtcaatccctccgattgtcaagtttcagcactcaggaaaccaaaatatttgaccttcacgctcactcagggaaagaaaaggtaattaacactcacggtcaataacattatcgtgcagtcaaagccatggcccatgtccacaaggacgtcgcggcctcttgaacctcctgcctcgagcagctttcgcgccatttttatgggtggcacctgccatgcccctgtcttgcatgcctgtcgcaaactaacacacattttacgtctatatgttccaggatg

SEQ ID NO: 8148 - DNA, 700 bp, Nannochloropsis_gaditana
agaagaagcaggcgttgcgcgggacaggaaacgcgatttttttattatctgaggccggtaaagagataggcagcaagacattgtcaacataaagtaaattttaggttcaaaaactatcttctcactgttgaagcatacaaacctcttcatactccgctggtccggccaaagtcttgaatgacgcgcttttggtggccgccattaatggtccaaatacagtcatgctgccagtccgcaaggcagtatgcgcaaccacccgagtggcagcagtcgtactaaatgcagcggttaattttatcgactgcggccatgagaggaaagtgacagctcgcataccgcgcaaaaggaaaaggactgatgccacgggccccagtactgatggaatgtatccagcacgtttgttgtgcatggtactgcgctaaacaaaatgccccctcacgagcttgctcctacagcctgatattcattgcggcagggggagaaatctggagagcatttgagtttttgtgtagcgtgagtttatactgaggatgccgtagtgaaatactatcttagtaagggtggggaggttgacatccagtggcgtactgtaaccgacaattttcaactccaccatgaatttacgtgtcgcatataatggtacaggtatgcaaattatgtcatcagactccggttgatcaataaacacgctagaaaaatg

SEQ ID NO: 8149 - DNA, 700 bp, Nannochloropsis_gaditana
ttcggtcatatccatggtacatgcccagcaacacacatcaccatctgtttcaagtcctgtgacaaacactcgccgctcttcctggggatctcccgcatgtagtgctgcctcttcaaagaaaaaaaagacgactttattggagccccttcaagacccgcgccgtatcccaatcgacaccacgcctgatataaagactcatgtcacaaacagcgtaagtccaccagatgcgattaaaggccgtcgaataagccgggagaaacggcgacgcagcctggatgcggccatttacggttcttggcaacagcaacgggtgcttcgtgaagagcagcaacaagaaaggcgccgggcagccgagcggaccacggaggtcttctcaagatatcaaaaagcatcattctctcccatgtccaaggagggaactcgagagcctttaaagaagcctcttcccgccaatttccacccggacgctaccgttgctcctggagattccgcgatactgagtccgcggtcggacttgtcctcgatgcgccgtcttggtccctactacctcggccaaaccattggagaaggaacgtttggacgggtaaaggcgggcgtgcatgccctgacgggagaaaaagtggccatcaaactcctggaaaaaaacagaatcgtagacgccggtgacgtgcggcgggtgacccgagagatcgacatcctg

SEQ ID NO: 8150 - DNA, 700 bp, Nannochloropsis_gaditana
  misc_feature (1)..(645): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccttgggcccgaaacgcccacgactttgtccgtcagcaccggcaggccttgg

SEQ ID NO: 8151 - DNA, 700 bp, Nannochloropsis_gaditana; identical to SEQ ID NO: 6952

SEQ ID NO: 8152 - DNA, 700 bp, Nannochloropsis_gaditana
  misc_feature (59)..(68): n is a, c, g, or t
cgagggcaatagcgggtaggagtcacgacttccgtcgtcgccgtagggataggcgggannnnnnnnnncctcacttgttcaggccttgactcttaccttcctggcggaatggggtgatcgttcgcagatcgccacgattgccctcgctgccgccaaagacccttacggtggtacgtgctctccctccctccgtccctccttccttccttccctccttccttccttcctccctcccgcctccaccccatgctcgtgaaacgcttggaacaatttctccaaccgacctccgtctgccctgccctcctaccctccctccctccctccctccctccctccttcctcagtgacggcgggcggtgtcctcgggcactccctctgtacgggtctggccgtgctgggggggaggatactggcggctcgaatcagtgagaaaacagtggcatccacggtaggtacatcgtcttggttcaaccctctttgccgcggggtctggcccgctcggccgccagcttgagtgcaatctcgttctaacctcctgcccccccccttgggccttcccacccttccttctggcagggcggagtcctcttcctcgtgttctgcgcgcattccctgatcgtcgggccctgagcgagcgagggagggagggaggaagggagggagggctgcgattggtcccgtgggcgtccggcgtgggatg

SEQ ID NO: 8153 - DNA, 700 bp, Nannochloropsis_gaditana
  misc_feature (1)..(559): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccccctttctgtctttctgctttgtgtccctctttctttctacgcactaaacttcctccctttcccccccttccctctcccgttcccgtaccgcagccacgccgccagcgcacggcgcctccaccctttgccatg

SEQ ID NO: 8154 - DNA, 700 bp, Nannochloropsis_gaditana
gtcggcctgctacccgtcggcggcgcttggctctggcgcggtcatcgtcaccaacacgcgcgacatcgcggcggatgactatttccagggcatgttcgccaccgccctggaagagggcgagatcgtcaccgaggtaaagttcccagtccccgaaaaggcctgttacatgaagttcgtgcaacccgcctcgcgctttgcgctggtgggggtctttgtggccaagttcgccgacggggtgcgggtggctgtcaccggcgcgtcggaagagggcgtgttccgttggaccgaggccgaggaaaagctgagcggcgatttttccgcctcggcgctggatggtatgagcccgcctgccgatggcatgatttccgacctgcacggatcgggcgcgtatcgcgcgcatctggtgggcgtcatgacccgccgcgccgtcgacgccgcgctttaaagcgccgagaggatcaagatgaaaggcccggtgacgcgctcaccgggccttttgtcgtttgggctggggcaggcccggtgcctgaattttcgtcacatgtctgtgatctgcacgcggtagcactttgtcaaaatgtggcatgacaggcaggtcttgtcaggtggcaaacacgagatatagtgatgataggcatggggcggcacgtcctgcccagggccgggttggtagcttcggttgggggatcgaaacaacatg

SEQ ID NO: 8155 - DNA, 700 bp, Nannochloropsis_gaditana; identical to SEQ ID NO: 5529

SEQ ID NO: 8156 - DNA, 700 bp, Nannochloropsis_gaditana
tgaagggccgacgactcaggagcttaccatggcaaatgtactagatggtcaagtacctgtgcgctgtgcgaaaggtctggaaaattgaatcatctcagtgaatttacccatgtgcagggcaacttcaaagcctgctcactttcctttttctcccccccggtccaaataaggcacgtgttgaaaagagatgagaacagcgtaagtttcacgcaaacataatgacatgccgcatctaatacatctgtatgtgaatgtgccaactggtcaggtgggccctgcacttcataagtgctggggctcgcctgacatgaggcaggggaagggaacggttccagagacaatccctacgcccattgcagtattagaaattgctggatgatctgaacaattgatatccgttttgaaggatattgacgcttgtatttcggggggctttaaaccatgtggggatttactcaatacacaacgtcctccggcaaggcagccaggaggtttttggcgagacaccagaaaatttgcgactcaacaagggactgttaataactccatacacaggacaattaaactgttcaatgctgagagatggctgaccatactggcgtggagataaacaacgcaggaagtcaggtgggactagagagagggaacgacatcaatttccaacctccctccaccctccggggttcttaaaaaccactca

SEQ ID NO: 8157 - DNA, 700 bp, Nannochloropsis_gaditana
tgggcgtgacccgtacctttgacctgagggtgcttctgcggcccctggacggcgatgtccgccgggagtacatctttgcgcaggtgcgtgtcctcgcttcccgcgcccccccctggaaggcctcggccctcatttccggcctgccccttgaccctctctccgttcgatcgctccattgccccccttgatcccgatcaaagcctgttgaccgcccaggtcctcgcctttcactttcaccgagtccccgactgggaggccgacctcgtttgactccattttttcttcctctcttcctctctccctccttttcttccccccacgcccctctttcagatcgagaaggaagagcacgcgaatctctcccagtacttgcgggacaagcagaccatcaaagtcatcgacgacaagcccgtttcccaggcgaagatcgatcggatgctggaggaggaggaggagggaggggaggaggaggacgaggaggacgaggaggacgagagttacaagggcgaggagagcgggagcgaggggagtggaagcgaagggagcgaagaagggggttcggacgactcctccagcggggcggagatggtggaggagagcgacttggaggagatgacggggatcaaaaaggagaaaagctcgaaggggggaaagaagaagaaagagaaggggagtggcgaggaagggagcgaggaggagg

SEQ ID NO: 8158 - DNA, 139 bp, Nannochloropsis_gaditana
gggcgggaggcaggaagggagaaaggagtaagctcacgcgggggcccgggaagaggcgtcggatgcgggaggagagaggacacgatccagtgcctcacgtcctgccccccccccttccctccttcccccccacaggcaa

SEQ ID NO: 8159 - DNA, 700 bp, Nannochloropsis_gaditana
ttccttgatcacaccccagagatttaaggccctcaaacatccccgaaaagtccaacagccattgaaagataagagccgcgaaagttctactataggcttcccgtgatgaccagccactgggacacaagagctgcgaaagtccttttttaaaggtatttcgtgatgtagggcaatcaagtgtcaggggcgctgagccatgtggcgggcaggggctttgcacgattagattgggggggaaaaagagtcaaagtaatggccggtcacgtgcccattttctccaacaaatgcacgtgtctttgacactgtgccgcgtccttttgtttctgtgtcgtaggctgtgggtgtcatttggacggatgaaaggaaaatgatcagggaagggggagactgttcatcccaaaactcctagcaaaaagggacttcaacaagtcaccacatgtccctcaagtacgaccctgcaaccatcgtctcgcgctgccgccatactatttgtcctatcttaaagcccattcaattaataatgcggctgccattggtcagcgcgggctttttttccctacctgtgcacgcttgtgcgtccttccccctttgtgagggctgccgcaacacgaggttttcgctcttacgcgcactctcttttcaaactttcttaatcggcacgagactagggaagtacagagacgctacgataggcagtatg

SEQ ID NO: 8160 - DNA, 700 bp, Nannochloropsis_gaditana
aatctgtaccaccccaccggatgaacgtcacacttcttgttcacagccagctcaacccaaaccaccatttttttgctcgtggtaagcaattgattgccttccagaagccaacgactgccaacttccccagcaaatcccgatttttacccgtattttgccgctctcccccaatttaccccccacttcaactgccaaacccccacttctaaagtcgaggagttgatgtgggcccccggagagcctgcaaatgtttcattgttccttcggtgcaaggactcaattgatgtcgctttcgtcaggccgcaaactaaggacaggggatgcaatgtggaatttcctcttttgacattctttaaaaattaagatcgcactttcatagagcactggtcgcaaagtatggtgatttgccatgtggtattcgtcatggacaggacctgtgtgcccctgatgattacctttatacggcttggcaggattttatgggctgcattgtgatctcacgcttttgctgaagcctaacgcatacactcacataagctttgtgctctgcttgtacgttgtaaaaaaagccgtggaaagacgcaggagctgtaagggacgtatctattcctgaaccttcctgacctttccgaatttgttcgaatatttactaatctgggccccaataatcttgcatcacagcactctatcaactcaaatg

SEQ ID NO: 8161 - DNA, 700 bp, Nannochloropsis_gaditana
tgagttgggcgacaaaaataatatcacgcaggtgtgtacatcagtacatttgagagacttagtagctgcttgaaaattagtaagaatgaaaagggaggactgggaaatgaatctacgagcgatttgagtgatcaatgaaataggttttggtcacatagcaaaggagttttgatgcagaagtatgatagcggggtagaacacgggtcacccatagcgggattcctatgaaatgcggagggtgccgcaaaatgcgatttccatgctcagagtcatacgaaaaagtaactcaatctgaggtacgtgggaccgatttaagtagatgtgcgtatagaaagcatcggtgcgatgcatgccgcacggagacatcagcaattttggaagaggagcgagaatggggaaaaagtaacgaaagaaggctggaaggttggtgtgtggcatgtctgtgggtgcccgagtcggcacatgtttttgtcagacacacacaagggaatgctttcgggggtaagacggagggcagaggataaggtagggagggaatcgaggaaaccgtacgggagagggcgtgacacgttcttcttcagtccgccctcggtcgcctgccccgatgccgctgtcgtgtgcttgcggatgggaaccctctctttgcggtgcgaggagttctgaaaagacattcgggcgacacggattgaaagcgaagatg

SEQ ID NO: 8162 - DNA, 373 bp, Nannochloropsis_gaditana
acaacaacaacaacaacaacaacaacaacaacaacaacaacaacaacaacaacaaccacctcatcatcatcatcaacagcaacaacaacaaccaccaccaccacaacagcaacaacaccaacaacaacacgagcaacagcagcaaccactagaccaacaacaatatcatcggcaacataatcagcaacatattcagcagcaacaacaacaacaacatcaacaacaatcacaaccacaatcctttcaacagcatcagcagcaatatcaacagcaacagcaccagcaacagtggcagcaacatgctcagcaattgccatcgaatagtctctcctcccccttcctgccatcttccatggagaatattcaattgatg

SEQ ID NO: 8163 - DNA, 700 bp, Nannochloropsis_gaditana
ccataggaccgagacgcgttcgcgcaatttttcccgtttcgacgccaggttcgcacatctggtggatatcctgggggcattctccgctcactggtaatttatctcgtcatgaagggctttagagtataatttattgagcagaaagtagaaatgtacaattcaaggtccaagtaatggaattcagacccgaaaacgccgcaattggagaggaaggagacggaggcaggtcgctgtggcggcttgcgcacaaccactttgcctgcgtggaaaggattaccccctgacgtacggagcctctcgctgtacttgcgttctcaaaattgcgtgctagcgcggtttattcattgcgccgcatcagaaacaggttatcacggtggactttggcgctgtcagccacatgccgccttcctcaacggaaattggcccatgctggctttcgcgcgctggacacacacacgtacactgcgtgaacctggtcttttttggattttttttgccgaggcaaaggaagttgccacggaaataatatgtattcttatatttcatttgccactcatactgtaggtcatttagatcacaagttcgcgacattcttgcaaagctaccacagcacggacgccgaagcaaaggaaggaggcgaaagatgattcggcgtgcctgagcctttttttcgtaaaagacggtcgcgattgtacaaatg

SEQ ID NO: 8164 - DNA, 700 bp, Nannochloropsis_gaditana
tggcttcaatcagatcaataatcagaaaagcgcacttccaaatgacggcgaagcaagcaggcgagggcacaaaatgagcgatcgagagcgacgaccctcttcctcattctgtctccttttcttccccctcttattttcctttctttccccctttttctcccctttgccgcgttcccaggcctgaaatcgccttgttttcgccacaaagggcccacatatttgtgttgggtcaccctctccagctcaagcgtcattcataaacagaagcttaccactgatgggtgacccccattggtcatccctagcagggtaaagtttaacgagaaacatcacgcaaggggggactgacatagtgacggctgagagacgagaaacgtcacggggattaaaaaagtgccggctgagggacgagaaacattacggggggtaatattgtgatggctgagggacgagaaacatcacggtgagctgtgagtaacggctcagggacgagaaacatcacgggcgccgcgcgacagggctggtccctgccgggcgcagaaagcgtactgttgcctttagaggcgttgaaggtcttgcatcacacttctttttagcaaagtgccgtctaaagtttgctctttatgattcgttcacgtcacatagacgcttttcagtggcgacagacagggcaagcgaaacgacggacgtctcgagcatg

SEQ ID NO: 8165 - DNA, 700 bp, Nannochloropsis_gaditana
agtcagatgtgttttcttcgttttctacctccactcaccagccatcttccgtagtgtagacttctgtgctgcctagggccgcgcctaccagcagcaattcgttaatcaagggctcttccatacctcacttcccgatcagagtttcccgcctcacggcaggtgaagctatgtttggcggccctagggaggggagaaagtaggtaagagaggacggcgcggacgaatgaaaaaaccgagacaagttttcaagacccagacaatggatccgcgaattgcaagccttgacatgacaattttattccccgagagacatgcacgagagggcaccgtggggggccggcaagttcgtagagggcgagatgggcgaggggcgggaagcctgggcgatcgagtcactccccgcggtgcagtgaaagccatggcccgcactctgcgtcctgcccaatccatggaccaatggatagcgtgggtgtgtcatcacactgatcgtgtcggaggtgttcacacgtgcgggatgtggcctcggcgttgccggcctgtctcttgctacattccgcctcatcgcctccctacgtctctcacgtctgacctctccaaccgcaacagccgcacaggaggattccctccccttcgtgctccacccatgagggcattttatctccttgcattgtcttccctccttgctgccaacgtggcaatg

SEQ ID NO: 8166 - DNA, 700 bp, Nannochloropsis_gaditana
gagacgtacctagtaaccttcgaggggtacggcaatcaggaggtggtggggcttggagatatgatgctgcaggacggcggctcggcaaggacctcgagggacgtgggtgggcagcgggacgcgagcgcggacaggcggcggagccggagtcggagcaacgggcggagccgaagtcgggagaggcggcggagtcgaagtcgtagccgctccttcgaccgggggaggaggtctgaccgagacagtgccagggacggggagaggagagaaaggggaagaaaaggaagaggaggagaaggagagagtttacttgggcgggaacttttggaagaggtgcgtaggaaggagagagaggcggcggcggcgcgaggaaaggagtatgggcagcgtccggctacctttaagggctccttgtccttgaaagtggacacctattcccaccggagcaagaccacctcgcacggtggagatcgccgccggtcccggtcccggtcttacgagtctcgacctcgacacggcgccaggcagaaacagtcgcctcccatgtcaaaggaccgggacgaagatcggcgagaacgacggcagattgctcccaagcctgaatcccagaaacttaaggcgctgaaagcattttatggggatgcctcggcgcaacgacaggacgattgagcaggacacgcaggagagtgcgcggatgtcgatg

SEQ ID NO: 8167 - DNA, 700 bp, Nannochloropsis_gaditana
gcatgaccttttaaaattttgcaggaggcatgatgcgtcccaagtgcgacatttcacgagaagcgacatgcggtgcacaggaaaaaaaaatgaacgaagaaaaaagaatcgagtctctctcttctcgaatcaattcctcgagttatgaagatacggattacatatgtacgctatggatgtggacgctgggaaaaacaatgcaaaccatgaccgtttcaattgttttttcacatgttaaattcctggtcttcaggacaagtttgcttgtgtcaacgctctggttccagagcgcgaaggcctacgtgggcgcaacaattgccataatagtctacgccattatctccctggtactggcgccagaaatgaccaaaatttgaccgtcaaaagcccccctattccgactcgggggcatggaacttccatgatggacgacctccttcctcgccatgtgatgattaaaaaggtcacagaacaatgtgtctctgcacgaagccacatgtctgacacacgcacaaaacactgtacggactttttacgggtgcgacgacaagaggtggacgagtcctggctgtcttgggggttcacactgaagtgaagacggaggagacgtcttgagcgattcccggcgacttactggccgtggcggacgaggaggaggaccctgcagaggttacgaggcacacaatccccaacgacgatg

SEQ ID NO: 8168 - DNA, 700 bp, Nannochloropsis_gaditana
  misc_feature (407)..(416): n is a, c, g, or t
cggaataaatccaggcggcctcggctccttcgatcgctaatcatcttgttgagcagaaagcctagcagggacgcagattgagcaacgtgccccatctcaagctccgtgttgtcaataaaaggtgcagcacacatgagtgcaaaggtggccatgttccaaatttcttttttcttctcccgccccggcggttgccctccttcctcattgttgctactcctgggaatggccatactcacgaaggctgcaaaaagtatggaacctgtcttaaaaagtgatccacatgcatgcatacatcaaattaaaaaagtcttactctttacaactttgatgagttaacccttcagcacatacatgtacgtttgagcgcggtacaagccgctagagaggcagggatgacctccttcccnnnnnnnnnnaaggtcttagcaacgagggttggtgggctttgacctgacggcgtacgtgctctcaatccatgcgcgagttcgagcagcctgcctgaccccacccctgagaggggaggtaagtcgaggaagaggatgagaaggagatgcaatttcaacagtcgaaggaaataacatcctatgacaggtttccataagcatatttgcgtatctttatttccttttgcctttttcctccccttctgccgcattaccaggtcccaaatcgccttttttcagccaaaagggcctacatg

SEQ ID NO: 8169 - DNA, 700 bp, Nannochloropsis_gaditana
tttcttactctctttaaaatattacatgtaggtggatgccaacgaggaagccgcaagcaaaagcaatattcgaaccattccggcttttcacttttaccgcaagggcaaacttgtgggcacgttcgccggcgccgacgagaaaaaactgacagaggggatcgaggacttggagggccgcccctgaggcttgcttgctgaagacacaattatttcgatgaagggaccaattgatgagtagcgtgtacatacgcagggggaaaggcccggacgatggcacagagaagcgactacgtttcacggaggggtgcttatgagattagtcgtaataagattcgtcgatgggaaactaaatagagtagtttgctcagccactacttacagtcgtggaaacggttggataaacatcatctagagcttgtctactttcgattttgggaggtccatgtggtcaggacgacaggatgaaaaggtcaaattcgagattgaggaacgccgacaggctgggatatgttgctctttgaggcaggcgcgcggatgcaatgccgctgtagcgccggtggtaaattttacttcactcttgtgttcagtgcaactcgttgctcacgggggttacgatcctcttcttcttttcccctcccgtacagggacgctgcgttgaggaggtcggggccggtgccggtcaggccacgcggcggggatg

SEQ ID NO: 8170 - DNA, 700 bp, Nannochloropsis_gaditana
  misc_feature (1)..(472): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacttcttggaaaatggcgtatggggtggaccggacccgcagctggagaacgagtgtcagtggaaggggtaccagcgattctaccaggtaacctcggcgggctatgtgttgaaaggacttgcacatcccatgcgatgcgacgggaagaggtgaaaactgcgcgttgtttttcaagtcagaatgtctgtggctcactctatcacagggcaccaacgcacgctttaatg

SEQ ID NO: 8171 - DNA, 700 bp, Nannochloropsis_gaditana
tacctttgtccgtcctgaagacacgcgaatagtacagcgtttgcggcaactagcataaataaacaaaatgatctaaaagtaaagagcaagtggcattgatttgccgcaaggcatatcacatgttttcttccgtgctgtacttcatatttgttcagctttacgatccgccttcacgctggagaaatccatggccaattgtccgaaacgtggatatgacggcgggggcagagggaaaggttcctttcagtagtgctctgcatgattcatagtcgggttgaccaaaattgcggccatcattcgttatctcatatgtccgtcgtgcttggacgcactgccatttttgggaaaaggtatgagcgcttgaagcgaaagcagcgacagacggcgctaacgtgatactgccctacgcatgtgagcattttcttcacggcatgagttgcgttcgacaaaggaaattgacgtaggactggaacaatttttattgcctcaagatggcgtttggtgacaaagaaacgagcgtctctttgttaattaaaccgtaaaagcagtactgtaatggagcacttggctgtgcttcaggtgctcgcgtcttgttgctgttgcctgcctgcgacctggatatagatggtaacagtttggcacaatatgaatacaacacacaaacatacaaggttcaaatctgtttagtggacacgtcatg

SEQ ID NO: 8172 - DNA, 700 bp, Nannochloropsis_gaditana
  misc_feature (215)..(224): n is a, c, g, or t
gctacagatgtgaagattcctttcaccgtacacaaaaaaagttgctagagggttgatttctcttctcacaaaagttcgctggcaaacagcaatgtaacaaggggaaaaaaagcggcgaaaaccttcgacggcgatggcgagcggcagcaagcggggtcacctctacattcgccccacacatccgggtcgcctcatgttgacatcctccgtcttgnnnnnnnnnnaccgaaaatgacatcgtaactgcatttagcagcagcacgactgccgcgattgcgacactgcgcatcgggatcgagaaggtgacggagacgacggtgaaggtgcccatgccgccaacacgtatttgccaagacgtgtctgccctgggtgagcaaagaggctacaaaattacctttttgtgctgatgtgttcgggacttgcgcagacatgtggcttccgtaacggtgagtggagggagggagggagggagcgataacgtgataggagaaggctgagcgagcgtccccgccagccctgcgtcttcgtgctgaagaatgactcacgctctctatgtcataccatgcagacatatacagaaaccagtgggcggaggctcttgaccccttccagcggggccaggcccttatccggcgggtagcggagatagtccaggcgctgggcgtgggggagtacctcaccgtcgtagataagggcgaca

SEQ ID NO: 8173 - DNA, 700 bp, Nannochloropsis_gaditana
  misc_feature (1)..(697): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncct

SEQ ID NO: 8174 - DNA, 700 bp, Nannochloropsis_gaditana
  misc_feature (189)..(359): n is a, c, g, or t
ctgacgaagagcccaaaccgccgaaggagaaggaaaaggagcagggtgatctcgaacaggcgcggcattgtgcagcgcaaggtccgagggagcaatgcgtaccagacagcgaagcgggcgtaggaaggggaagggaaagaatctcttctacagcgtcgtcccgaccatggcgtcatgccaacgagagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggggggaagatcgtatggtaaagagcgagccaacgggttcggaccacccccacgccaaatttcctccggccgtgggcaggggggaattatttggattgctggtgtcctgatgatggatgctcggcttggtggttgatatgatgcgtagacgctttttaagattgtctcgtggggcaggatgttgctttgtttcgggcactggcacttggattataatgccccggtcgtttgccagtgcaagtcagtcaaggacatcattaacagcatgattttttttgatcgcctttattatcccgcactcctagacccttcatttacatcttaacatatagaaatg

SEQ ID NO: 8175 - DNA, 700 bp, Nannochloropsis_gaditana
cagcgctttggctaccgcttacatgctgtgccttgccacccgcacagacgacagcgcgccaaacccatgcagcatccatttagcgaggaccatgaccatcacagacatggaaaaaataaaaagtaagcagcacaagcaacgccagcgcctgcggcgacgcgaaaccctcacaacgtactgccatgacacaatatatctccttattacaacgcggacgtaggcaacacctcgccacttgacaccctccttgtggtgggcacagggtcgagcagaaacgcggaatgatcatgacgatgtgactagtggaaaggaaggagggcagcatggggagttggacaagggaaagaaggagaaaggaggttggaacaagaagcgaaatgaaggcggggaagcaggcgcggctcttgcgtgtgccgccacaacctctaccgcgactactgataccgtcgggaccaccgagaaaggcaatcggggtcacaatcatgcccccctttcatttctgacccccacgctttcttgccctcctatgccattttggcctcagcggccgactacagccaacaccatgcggaggacaggatcacgaagcacctgctggaattggaccggcagcaagcggcgcgggagcaagccccgggctattcggtttatctcacacatcttaaccctttcagcttcagcgagaggaatattgtgcatg

SEQ ID NO: 8176 - DNA, 262 bp, Nannochloropsis_gaditana
ttccccccccctccttgccaggcacaatgggactggtggacaatgatgggcgtagagcgaccgaaagggaatgtctggacggaggaatgggggaggctggagaccgctgtggaggtatgacggggacggagagggacagggggaaagaggaaagaaaagtcggaggagaagagagagagggcggcgggcgacggggtgtttggccaggcttttttgatatttgtatgttgttttgtgacaggacgaatggaagaagttgatg

SEQ ID NO: 8177 - DNA, 700 bp, Nannochloropsis_gaditana
gcataaagtttttggtccgtacttaaagcgtgcgttatttttttccagccctgcgacgatatgaccggtcgccggtcggcttgtaatgtgtaggcaatcaataaaaagtgtcaatgacttaaaagaggggaagaaatcgtgtttcttacagtctaagtgacatacacctgtctggagctatctgaggtatcgatagatctccatggttgtcttaaacatggccgaacctacaaaatataggggaattaggaattgtttggtttcgtagcacaagctatgtaagactttttttttaaaaaaatcctaaaccatgagggtcccgacaaggtacaatgctatttctttcctttgtggtttccagtcgtggtgatgtaccacgtggccccaatcttgctgacagcctaatcaagttgtaccatcgcgctctccgcgcaaaggccaaaggtttccctcccctccctccccgccattcgcgccgcggccgaccaggcagtgaagacacctcgcatgactaaccctagtggccgtcgggcataaaaagtcaccacgtgacaccgcaagatcgacacgtgttaccatctacgcgcgctttcatattaatttctcactgacatgaatatctttgcgggaattcaacagagcttgtccgaacccgacatctgcaatcaaggaactgcaactcgccgtccccgggaccatg

SEQ ID NO: 8178 - DNA, 700 bp, Nannochloropsis_gaditana
tgtgatccacccggcttagaaaatgtgacaatgcccaaggagagactctagcgactcgtgggcgacgccgtgtcctcctagcccagccagaaatacacactgccactgaccggcttatgaggcgaccatacgacgggaacacccttggaaaagcaagtcgtgagaacaaactggctacgcagaccttgtccttggggtgtgtttcgttgtcttgttatcaatgcatttctttatgcctgcagctgccagccgcaaggagctccgagatccgtgcttacccaccgcatacttccaattttccaacttaggtcaggctgaaccgcacgttccaagacaagaggccgacacaagttgttggaagaacgtgtcgtgatcaagcgctgggggccgcctgagttcgcgtcatgcctcccaaaaaaaaggacagtgaggaggaggtggatagattgacgcgaattgccatgtacgtgccctgacctggaaggaggtttttgatccacaaactcgctacggagtttgtttgtaggcatttctgtcctccctatggcaatataaggcggtctgggaaatgtgccatggtttctgcatccttgtccggaggaatttagcgcaattataagggtgcctctgttcctccccctccttccgcctgcccttttctccctttctcatcacaccgtgcttgtaagaaacaataatg

SEQ ID NO: 8179 - DNA, 700 bp, Nannochloropsis_gaditana
ggaaacgatggaaacggggttgtattgaacattaaaaaagaattgacatgacgcttcttcaaatctggtggatgcggcaacagtgtagtactaacgcatctgttgatgagctctgtgaggccaaactagcttggggggtaataaatgggccattcagatatgaggaaatatcctggtttcaagatataaatctgaaatatacctgactgtgagttgtcaaataattgacgaaccatacggacgtatgttttcttcgcttgaatcaagtgggagggtgtatggcagcgtgacaggcgtggacaggacttcacttgaagtttcaacaacaagcctaacgcggcggtctgtattttctgatatcgccgggccaaaaaggagcccgtaccagcaaatgtcgcaatctttacgctttgcatggacggtcactgggttgacaagctagacgctacacaattgtggattttccgaaatggtgttgagcttggaggggctgggttattgttggtagttggtcgcgttttatgcctgagcagcgaggcgagcattttccccgcctatttcgaccgtgttgcaacctctttaatcaaaacgcacacgaaccgcacaggcacagatcgatgggttttttgcattccatctacaaatcttttttcataaattcttcactgcagcctgccacggaatcagatcggtcaacatg

SEQ ID NO: 8180 - DNA, 700 bp, Nannochloropsis_gaditana
  misc_feature (1)..(294): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaaagtgccacaacatttttaaatgcttgattgtccgtggtcatatcagatgtggaggaaaccctgtttcgtgtagttcacacccgtggtccgcgcgtgaaagggacaagagggtcctctacgcgtcgccagcggctcgacccatctttctcttagtacacgtactttaaagtcagatacgtcgaacagtgatcaacaaggttgctgtgaatatgtctgtgttcacttaaagtatagcgcagagcctctacgttctgtagcttgatttggaacaaaaaaccacagacgaacaggaacacttctcgtcctttgggagtcttttcctcggaacttacaaaaactgtaaattgaaagcacacggttctgtttctagaagcaaatcttacgccggtggaaagacatg

SEQ ID NO: 8181 - DNA, 700 bp, Nannochloropsis_gaditana
gtgccatctctgcgcgggccttcctagcctctcggtttgagcctatcaccgatggccgaaaggccaagcaagacccatacttgataaaattctaaaagcaggtatggaattatttttgaatgaccgcctaaaatcgtgatcgtgtgcctatacaatgtctcacgcccggcttttcgtccactgattagacacctgccagagcctagatgtcggttagatcgtattcgcctccaaaaggcatggataagtgcattatgcttggacaaagtgaaatatatcattcatgcctgtctgtctctggattttggctttgtatttcaatctcatccatatttgccatgcccctccgccagctgacctcaacctcctggttatgataaacctgtttcctgagtgtccccttgataaaatgggttttaagcctgccgtgaccaaccaatttttctacttcgcaatgccttctttcaacatcgataagctgcatggctggagctctgataacttgatttcgtgaagggaaacacgtgacgagtttcctccgtttccttcatcgcccttttcgaagcgtgtcgcctttccttcaccaaacgaagcgctgcaagaacgcgatttgtttccgccgccgccacttccctgaagcttgcttcccatttccatcttcccatcctacagaaaaaggagaacaggtggtactttgatg

SEQ ID NO: 8182 - DNA, 700 bp, Nannochloropsis_gaditana
cgagatgagcatggaggaggtgctggaggtggggagaggggtgctgggcgggcccaggagggagggagcgggaggaaggccgagagggacacaagggagcgtgcggctcgagaagggagggagggaggaaggggaagggcgggtacgggggcggcggcggccccggagggcgttgggcatgtcctacggcgccgtgtccctccagggagcgcgggcgaaccaggaagaccagtacacggccatcccggacctggcgggggtcgcatcgggggagacgggggccgcgcaggggctgccgaaggaggggcagggggagcaggcggagatggaggcgttctacgcgatctatgacgggcattgtgggatcggcgcggcccggtacgcacagcagcggacgcatcactacctgatggccgaccccctcttcgtgtcctcccccgaggcggccatggtgaacgtgtgtcggcgcctggacaaggaagtgctggagatgtgtgaacaagaaggcttgtactgcgggacgacggccattttgacttttttccggggccggaccgtgtatgtgggcaacgtgggagattgtgccgccatattgtgtcgggacgggaaggcttttcccctgtcaagcgcccagacgcccgggcggaaggacgagcgggagaggatcgagcgggccaacgggtgggtgacggaggagatg

SEQ ID NO: 8183 - DNA, 700 bp, Nannochloropsis_gaditana
  misc_feature (1)..(523): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggggggagtcaagggagaaaagttgaaaggtccctgtcttctccggatttttcttagtagtgaacgtatggaacacctttccatcaaccctcacctcccccgcacttcccggtaccctctctggcaggtccgtcttgtccgaaaaagggcggacggagaaatctacgccatg

SEQ ID NO: 8184 - DNA, 700 bp, Nannochloropsis_gaditana
agaagcacctaccaagaatttaaagtcttcaggctcttgcgatagagccgaacgactatcgtcttgtgagaaagctgcggcgccgggttgatatactgcgctgcagcggctcgcatggatgcattggccatgatagccgcccagccgtgtacctgttcgcaacgatgttggttgagtggcgtgagggcaggattgggcagagagagggagacaaagcagcacgggtcaggtaactgagagagagaggaagggcgtggcttgctgaaagagagcttatctctcccgcaggtgaacaacttgccgaaggcatacacgtgcgttgcaaccaccacaaaacattccacatatgcctacaatggtgggccactgtcgctgttgtgggccaacgctggccttgtccacaacattgtgcttgcgattagtcatggtatccacgcccctccgagtcgctgtcgctagaaccggaggtagttgacgtgggaaggttttaaagaaagcattttacgagaggtaacgcatggaatgataaggttggttaaaacggaagcagaacctcatgctctccttttttttgggggggggacaggtttgcccgagcccagcttttagtacttcccaaaacgctgccttggtgacgtgtgaagagggaacaaacgggccgcttgctggggagtagaggatcccttatacgcgggggatg

SEQ ID NO: 8185 - DNA, 700 bp, Nannochloropsis_gaditana
ccgaacgccaagggacgctgtgtcattgctggtgtcccgctagataccgcatgacatgcccaagaaggacattgagaagcgatgaacgacaacaatacgacaaatctaagccagcgcaaccgtatcagctgattccctgcttgagaacacggtgggaataatagcagtagacggtggctgcttctgttgcctcccatatatgaggctgctgcagtagccaccatcagcggcaattttcgaaacaatacctgtagtgtcaatgcgctgtcagtcaatgaacggtatgggtcaaaattcactttgcttgacgtggtcaaggcgacgtggaagatcgatgacgaccgaattgtcgacacgtacatctttttcatccctgcctcatctctgtaatgtttctcattcatcagatctccctctacgtagtagatgatgtctcaaactcagtatttgacgttgtatttgggggcttgtgcactcttttgttgtttttcaggggggacagcgatgctgctcgtatcgccagtcagcttcaatctcctctaccgtccgttctcacgcacgacccaaaaatacaactcaccttccttgcatgatgcgcaccccatccagggagcctagatgagaaggaaagaaagccatcgtcacccttcacagttaattcgttgtttcttgtcggcgtgctgtgtgccgcaactcgatg

SEQ ID NO: 8186 - DNA, 700 bp, Nannochloropsis_gaditana
aggtcgtcgacgaagtagctgccgttgcccttaaagggattgacaaatccgacggggagaggtggcgacgggaggtagagaaatgcctgaaacccactgcatagagggaccaaagaagaaggaggaggagctggtactttcgccgggatgctttgctcatcgcagcagcgtgagactggctcaaccaaaagggaggagggggaggtggctacgtcgcgcggaggccgggaaagtacaaagcacgaaaataatgcgtcgcgcaagttttgccttctgttcgtggttaggtgtatgaatcgggtgcgactgagcgaaaggtcacctcatcttgcacaggaagtgtacgcagttgccgtttctgctttaaggcgaggcggggcagttttagagagcagcttcgctgccctgttgtagatggtgctgatacgaaaaaaaaacacgaaaaactgaagtggacgcagagacgacctggcgtacaagcttgacatagccttggggcatgacgcgacttgtttgtacatgctgtctcggctttaaacgtcaggcaggcgggggaatctcgatattccctgttcgcaaagctttctcacctcctgccacgcacgccggctggagcttattcccacctgagactttgacacaatttcttgccgcatccacaggccagcaccgccatcgtcggccggaagggtctaccatg

SEQ ID NO: 8187 - DNA, 700 bp, Nannochloropsis_gaditana
aagagggagctgttgacaaggtacgcgaggaaggggggaggttcgacggggtgggtccttggccgggaaggggcccacacgctttgcggcctgtcccttgcgcctgctttttcttcggctcctcccccgccatcggatgatctttttttacctcactactagatagcccctttctcccctgtgtgccttgaggtcctctgctccatgtgttgttcgcagtactgcttgcttcctgccatgccctcgcctcgttttctgaggcaaatcccagcaaaaaagttttcggtggagacggtgccaggttgtaccggagtgcggatttcaaggtttgggcctcataagcctcgaccgcgaaatatgtccgaggacgagtgggagaagaagcggcgagagaggaagccctccttggccaccatccaagtgtccttgttccctcctcttgagcgacgtggatctccttgtgcactttgccaataacgagcttgagagagatttcacttttgtgggttggccctggatcctcattctctgtctttttcccgcacgctttccactccagcatgggatgctttgtatgtagctccatagcacgacggagcgtagcagtcccctccatccaccgagcctttcctttacgacctgtaggcatcccatcatcaggcgaagagatccatataggaccttcaacatgatgtaaatc

SEQ ID NO: 8188 - DNA, 700 bp, Nannochloropsis_gaditana
agcgtttctcgccaaccgtacacgcgcaaggccttcatgtatttttgcaccacagatgccatctttaattcctgggaatgagaccagatatggaatatgaatgcgacttgtgcatgcttgcaccgaaaggatcgcctcaggagccaggataattccatgaaagtctctgaatcctgagccgtctctcaagcttccacgacaccagacatctttccacgcacagatgacgactccaacaccgctatcgttcaacgattctatagaggtcaccccccactcaattaccgggtaatgccctttatctcgcctgtcctttctggctgcagagacgagccagacaaggtcttccgggagcaagccagcagcaagggcgacacttgctctgaggcctccctgtccgcattgtgaaccgaggagacaaataagttaggtcagggcaaaacttaggatcgcaggcattcacgtgtccacggcgggtgtaccaaagggtctgtcgcaggaaaagtctattgatttgagtgatatgagaaggacatgatcgccgtcgtcactggaaagcccctagctccctccgagagccaccgcaaaaatactacgctcaaatgcattttatcgatacgatttcaagctttcattcccaccgtgcccacgcccacagcttatgccccgtccgcatgcccggctttctgcccattccttg

SEQ ID NO: 8189 - DNA, 700 bp, Nannochloropsis_gaditana
gggggaagcctcgcgaatagggactcttttccgagggctcaacagcctcaagaccgcaaagccgactcaatacaaagaagacttcccaagcctttgctcgtcatgggacgcctcgatgtccctttcctaatcacgtgtatagattttcatttgcatagaatgatgaggcccactgtcgtatcactcatcacgccttggaaatagaggcactgtctattacgagcgttatctattgccaatacgaaagcgggattattgtttacgttgaaccaaacatgtaataaaagacagaaaacccgtagcgatcatgctgcaccccaagtcgggagaaatctcatctttctatgaagcatgttgtgtaatttgttgtcatgaccacgccaagatggctcgtttctcgtttactatggttacctcccctctccgtaagctggttttatgcgcgtcgatcagaactgatgaggaagcgcaggccggtgtaacacgcacaaattatcaatccttaccaaataaaagtccacgatgccaagtaaaaggtccccaagccgatcaaaatgactctcgtgtcacccgtactctggcaacgttcctgagcgggcgcctcgctgatatgtcacggcgagtatcaaggacgcacagagcttgacagcacgtcttccactatagcacagggtggaggaggaaaacaaaggaaagcatg

SEQ ID NO: 8190 - DNA, 700 bp, Nannochloropsis_gaditana
ccaggcgcctcacgttcgagtccagagcctccttcagcgaggccctcaaccctattccaacgtcgcctacgattgtgttcgatgggattggcaaatgacgcagcaaaatccctacactactgcctaggggcgtcaataaggaaggtcgtgcgcgcgtggcgcggaggagagaccggagctcctcgtctataggggatgcacatgtaccatcttgatatccagaccgaagggcctcagcgacctcggcaatccgcacgagtgcgtggtactcttgtaattgcttgcgagattgtcccgtgaatgcggcctgagttgcctctgaggcttgttgtgaagatggaagtgttgactcggagggaaaagatgaaagcgtctcggtcgcgaagcggcgaaggccgaatggccggtggacgctggctttagccaatagagagcccgcgccgcgcatgctgtgcagatagtgctctattgagttggtttgaagatggtacgtgagaaaaggagacctgaatgaccagttatgcgccctcgtggaacacgagcatgcatcgccctgcttcaagacagtgacgtcagcctctaccagaacgcaacatgtcctcgttttcctacatgcacgctcttgagcagccccattcttgactcgaccttacttgcacacgttctatcggtatcaatcaagagcctggctgcaaagatg

SEQ ID NO: 8191 - DNA, 700 bp, Nannochloropsis_gaditana
aacgcccggctccgactttccccttgtctcctttcaaggaggttgcggtaggcctcatcaaactctggattggatcggggcgctttctggcggttgctgggctttccacggctggggtggggggccaagtgggagagggaggatggaggagagggagcagaagagccgcggccgcgtttacgaattggtgccatcgaggcactaacgagtggcacacatggcagagtcgacagtgtcggagttttcttggagggtgtagcgtgcaatgatcggccaagcgctgtatcgaatttcgatatggacaactgaatggttagacgtacacgcacactgagtatcaggggaacggtttctctgggaaacttacacagagtcttgccgctaccgccgctgccacgcccacgtttcttcttgcccatgacgtgacactcagttgcgggcacgtctgtgaaacgcaaaaagtactggtgtgtttggtaaattcgatggtagccccctgcggtccgccccccaggactcgcatgtcgctgcttcgctgagaagggcaacttgttccttttccgtgccgccagcctgcctctcagcctgagtacaagccgaaccacgcacgttcctggttttcggttcatctaacatatgccacgccggatattctgtgctttcctacagacaggagtgacctcgacgacacctgaccatg

SEQ ID NO: 8192 - DNA, 700 bp, Nannochloropsis_gaditana
aaaaggcgacggggagggtggggcggagggagaaagggagtggggtgcatggagccgacagcgtttctatcgtacatccgtgccctgtccttgagtgttacccacatgataactctaatcctgaccctaatctgacatcttccggaccggcacgcgacagcaacgaagtggcgttagactacaatagtggtacggaacgaccgacttgccgtttgacttcctccccgacgcgtcggccctccctcccttccctcatgaagatgatgcatgtcatgccctgtctctccttcctgcgttcctcactccgtctctttcaccctcatgcaaaggtttccaaggggcagtggctggcctcaagcagctcagtgtgcaaaaccttttgaacgacgacgtgcctacaaggcaatagacgaggctgtgtttttcccactataaggggggaaggagacttgtcgaggaaaggggatggggagggaagccggtggactttgatgatagggagggcggatggccccactgcgtggaaggtatgacaggctgcacgaggacagatacattagattggcgtaacgcatgtcaaacgaaggggttttggcttgtgaaaaagcaataatggaaggttgttgggtggtggtaaagggaagggacacgggaaaagtctgaaaagggcgggatagatagtgagacatggggacagatg

SEQ ID NO: 8193 - DNA, 700 bp, Nannochloropsis_gaditana
agagggagacaggaaagtagcacgccatgggagaggaggtcgggctgctagagtggcacattggatggtaagggggtgaaatttacggcccgaatcgaccatcaatagaattaaggggtggaatcctgtgcccgagtcatgaatatcagacaaacttaccgaaatctacgttcggattcggtaatatggcgcttgcgctgatgagggctccagttttgaaaaaaggggaaatgcaaccgcggctgtcaagaaaagccgcctgcgtccaattcgaaggactttaacaaacgattctctgaccaaaatgccgcgcaggcaagtgggagtcagttttctcgcgtgaaagtcgaagaagatggagatagctgtgtagggacgtgcatggaaatggaaactgttggtactaattacagcaaagtgttagacccaaagtcgatcgtgctttcacgctgcagcgagcgtcatcaggcgacgacctctaagtggaacaaagctgctcaaatttcgagaatttcccatcacaacgtttgcatcaccctgatacatgctttgttgtcattgctacaatgagacaggtttgtccccgcgctgtgttttcatcctttggtcgcacctttcctacctcctgcccgggcatttccaccgcccccgtgcctactctgctgcaactttatccactgagcgcgcggccgcggccatg

SEQ ID NO: 8194 - DNA, 700 bp, Nannochloropsis_gaditana
  misc_feature (1)..(594): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcctcctcctccccctcgaaatcgacctcccccccctccaagatcaggccctcaagcacctcgccgatccccacatccacgccgtccttggccacgcccgcatg

SEQ ID NO: 8195 - DNA, 700 bp, Nannochloropsis_gaditana
caatcgaggacactgcatcgcaaacagcaggaacagggtccagtgcgcgcatgatggagctttgtggtgtgaaaggattggcttgtggccgtcgttgtcctgcattggaaggaatcgtgacatgagcaaggggcaatacgaagagctactgaattccagtgtggccaatgcgaaatcctgctctctcaaaaccttgtgcggcacgtcacatacggtgcccgaccaggaatgaggcattccacctgtatcccatgtaatactgaacagagcatgaggaattgcctggcatggtatacgctttgttaccatagtatgtctcctcgttctgcctctcttttgtctcccttctcgtgttttaccccgtcgagacaaatagtacacctctgcccctgctcgcacgcgctttcccaccgttcgtgacatgtcatggtgaagactgctggtattcttacctcttctacgatctggctcgccgggtatcgcccactttttgggtgcctcaatgatcgtcgcgtattccccctccccaccccaatggcctcctggtgaccatgacaatctacccttgtcgcgttcctaccgtccttcttccacctgaatgtgcgcacggtgtcgagctgtatgcccattcatgcacccccttgcattttggtacaggcattggggagttcgtccgactggacttgccacgcttcccatg

SEQ ID NO: 8196 - DNA, 700 bp, Nannochloropsis_gaditana
ctagtctttgcgcatacaggtacaaaagggtgctgcgcccctgtcatccctcgcattcatggtccttaaaatgccttaggaccaatggaataccgtggttatctcatgcatgtaggccgttctcttctttgtaataaagaattgagcctaaacgttcggtctaataccctcccttagccatgtcctcaatgggatgggatgaaggataaaaaggtctcagataggaagaaaacaacagattattcaggagatagggttagggttatgcgctactcttcttacagattaccacacgatggtcgttaagacccttaagctgctgggattgccatctgtgcgttattctgaggattatcgtggcttcggctcaggtcatcaggtgctcgggattatagacgtgaatccttgtcacttgtattgagatgatgccggactgatactgtcctctttgtgtcgcttgcgttttccttttccgtttctgtcccacttgcatgtttgtcgaagacactttgcactgttcatccgtcattacaagatgcgagtccttagtacgattgatacttcaaccattttgatcctatgtgacaatttgttgacgcgttattccttcgttgcatcaattcctcccaggcattacaccactggcgtccaaggcattggctttctggccttcgtcttcgtttcgcgcgtcatcagcatg

SEQ ID NO: 8197 - DNA, 700 bp, Nannochloropsis_gaditana
acttttcgaggcattctaatattatgtgtgatgacagatagcattttcaaaggacatcattgcataaagtggaccatgaggtggccgtgaatgtctttttgatggggttaacatgatagtaacttggtctcaatcctccttcccttgcgacttggcatgcgatgaccaacaggatgcgttttcacgcatgctttctcctcctgaacgtcatatctggatttcaagcctatgctcgtcaaaccaccaaatgcgatacgaccgaggccgagcgtgcagaagtgatgagaagaacattggaaagtcttgaaaatgagtatgaatttttgccaggttccttgtcgtttcctcccttcgcacagccagcgggacgatacggtttaggtattgtgggagtgaagaaggaggggggagggatggaaggagggaggaagggcttgcaggtcgtcgagagagccaggttgatcaagcagacatttccccatcttcaaatcacccttcaaaaatagtggctttcgacggcaaggttgtcaatcctcccgccctctgcgagataacatcccgcgtcgatacaccttacggtccaggtacgagggtgtgggacttcatgtaccttatagatccatggctagtcagcatccgggtactcgcgccgtgtcgatgggcggttggacagggtacgaccgttggaaacaccaccatg

SEQ ID NO: 8198 - DNA, 700 bp, Nannochloropsis_gaditana
  misc_feature (639)..(648): n is a, c, g, or t
tccttccaattttctgtcatatttctgtcaatttctggatcagtgtacatttgaaaaacaacatctgtcagaaacttgtgctaagggtatcaaatagcactttagacagcatccatgggtaagacttaagcggactggcgcttgtctccccgtcaaacaaaattttgataagaagctaatgatttcctcttatctcaagacaagctcacaaaacgtacccagaatcaaaatatctcagcttgcacaagatgtttcgtacaccttgaaaattaaaacaagaaataatccaatatttctggttatttatgtggaatgcccctttagtagggcttggggtccgttccgatcttcctgccgcctgcttcgcgccaaaaattcatcctctgaagactgtgctcgtgcatcgtcatcggcgttccatggcagtgactgcgtaacaataaccagcgtgccgggcggatggcgcacaacatgtaccgctgtagacggagataagtgcttggtctccaggacgccacagtggggagctagactctgggagctggatcaggacgattgtgctatcaagcagaagatgtccttggagtcgtcgctgagtcgtacctctcatcccgcttgggcaacatgattaaattaccnnnnnnnnnngagcagccttccacccttgtccaaggctacatttcagccaccgtccccaatg

SEQ ID NO: 8199 - DNA, 700 bp, Nannochloropsis_gaditana
catgacgcaagcgggtctcaacggccgacgagcgtctgcgcgtgaaatgagcaaatagaccgcgcccacccatcacaacaacaacgcgcccgggcgaataaatgcatggcccggacgttctgggtggggtgcggttggcaggtgggagggactgtattgtcttgaggatggatgttgacttgattagatacacatttttttcgacgtttctaatcaccacagccactcagtcaccatggctgtcatttccaataaggtgggcggcagcaagcggaaagtgacctccccaccctccgccattacagctcgcacaaacccgaaaaaaagcaacacgttgagcaaaacagatgaagctcaaacgacggccgacaagcttactttgcctccaagccgcgtcgatgccactcaggctactcgtgccgtggaggcattactgcaacataatgctcggcaccaggctcttgtagcaagcaaaaaatccaaacaggacctcttagcgtccgaggcaggcgattacatattgatacagatagcgcttgccaaaattcctgaacgtgtgagtcccaagccggtgcctttatcattgccccaccccctccacggtagcggcggcgacgacgatgaagaccatgccgtgtgcttgatagtaaaagaatcggacaagggtaaagttcaacgcgcgttgaatgcgatgaaaatg

SEQ ID NO: 8200 - DNA, 700 bp, Nannochloropsis_gaditana
tcttttgtgcagcatctttgaaaaacatgtacgccaacctccccacccaaaacctcattatagaattacgtccgttacttgcaagcattgcaaagatagggtaattacgggcaccctattcctaggtgacaatgagaaatgcaaggtcactggatacagatctcatgcatgtgaaatgtccaggccgtcaaaggctttgacgaggaaaacctccttttacacattttcctccgacgacgccggcgccggaggacaaagacgcttctccattcggcttcctcccaaatatattgccagatatcacaacatctttaatcaaaaccaatggcatcacgtaccttgttacaccccatagccaaggtcgaggcgtcactttagtggccaatccgcctgaaatcgagggaacgtaggccggcggaggccgacgcgtgctccccttcagggtgacgcaaggcttacgtgcctcgcttgattgcctcgcgtaggtggtttggcgacattgaatgctcagttctcgcatggacacgtgcccacaccttgatggacggcttgttgagcaatattcataagctgcgtctgatgagaagtatcgttggattgctttgtgccatgttagcgtgggtgtctcctcacatcgtccatcttcccgcccgatcaacccctttccaccaggcacggggcaggcaccgtcaggaagatg

SEQ ID NO: 8201 - DNA, 700 bp, Nannochloropsis_gaditana
  misc_feature (1)..(530): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctcgacatacgccatcattttatatcattttgattggagtgtcaatccaggcattgcttcgaacgctccttgaccacctccttcttccacctcgcttgtgacctcgtcctggttgctctgctcggatacttggccacgctcatcgggcacccagacgtgccgacaatg

SEQ ID NO: 8202 - DNA, 700 bp, Nannochloropsis_gaditana
  misc_feature (1)..(370): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgcgcttgcctacatcacctccctgtccttcctatcagtgtaacgcggtccccgcgaaccgccgtggcctcgaccaccgccagcacagacactggcaccctcaccagcaatagtcatgttcaaacgaaaaagagacgtcgtgagaaggccacccggctcggcaagatcaggcctgttttacatgcactgcaacagacggcctcacgagcggccccgcccggctccacgcgtcgcagtctcgtcaaaaagtttgcccgaggggtacttttcctccccccgctttttttaggcggtgctctcaacatcgctgctccttctggtgcgatg

SEQ ID NO: 8203 - DNA, 700 bp, Nannochloropsis_gaditana
  misc_feature (121)..(130): n is a, c, g, or t
  misc_feature (301)..(310): n is a, c, g, or t
  misc_feature (688)..(697): n is a, c, g, or t
tctctcctcacgcccgtggctcccccccttcctccctcccttcgcgtccaccccgtttcgctccctcccgtccctcttctcgcccctctttacaacctttttcaccagataccccacttcnnnnnnnnnnggagttcagacgtgtgctcttccgatctggggggcagggccttgcgggcggagtgtgaggacaaggttttgaaatggcaggagccatcgaaagggaaggagaagaaagcgcttccggtcccagagatgtcggcgcggaagaaacgggcgggcaaacgcgtgaccaaggcgnnnnnnnnnnagggagggggggagggaggggggaagggagggaacggaggcaagctggtaccgtgcggacccacttccatgggaggagaggactcaggagccctgtcccctgcccgtgtggcataaggcgtgccgaccaccacgaggcgtcacgcaagaggaagaagtacagcaacatgaaagtaaaatgaagaacccatttttgcctgccttcgcctgggtggtggaaacttcacaagcttactttatgcatttacatccttccaccccccctcccctttcccccttgatcggcccttggcatcgattccatcccatctcctctacctcccttcccccagtccctccctcccgccctccctccccacctttctcggccccagcgtgnnnnnnnnnngac

SEQ ID NO: 8204 - DNA, 700 bp, Nannochloropsis_gaditana
  misc_feature (426)..(435): n is a, c, g, or t
cgggaggcctactcgaggctcccgccggtccttgaactcagccacttccagtgtgtccagctcactcgactccgacgttccccccctgcctcccttggtgcgaagaacgagcagtcgcggcgctcaacccccgattcccatggatgaggaggagcgaagcgagactagtggtgaaccagggggagggaggaaaggaagggaagaaaatgcagcttcagaggctcctgggacgggaaattcggaagcggagggaaaggcgccgaagacagagcgtgggagccccactgggagctgcagcagccacgtcagcagcaggtccggtccagggaatggcacacacaggggcgaaaaggtggaaaaggggacgacgaaattgacggagctggaccctgagacgtgggtaggacggcgggtgcagttcacgcnnnnnnnnnnttcggtgagagagcaccgcccgtaccaactccacacatctctgtggcacgcgcatcccatgcaagaaaccccgtgaaaaccatgttcccgacgcctgcagggggtcgtccacgcgttgttggacgcgccgaggacaggctgagcttcgtagagggtgcactttacgattttggtgtccgcagtgcattcttggtctcgtcggcgcaagagagttgtcaggcatggctcaaagtaacttattcctctcctcgccgtatgcaacatg

SEQ ID NO: 8205 - DNA, 700 bp, Nannochloropsis_gaditana
tttaccacagctgccattgccgtaggtgccactgtccgtggtatgagagtcctcaggagcaagggctgcattagggagggcgggttcgttgtcatgtgccattgtaaacaactcgcacgtgaggacgacacgtccgcacttgccgaccagcaaggcactatcgtggcttgatcatacacttgtaaggttttttattggaaaccagctggtcacttctctaatggcacggtagaagcatcttggagtccgacaacgcggctagcagcgtcactggacagcctgcccggcgtctctgtgcaagaagtgaacaaagtttgaaacacagcctgtcaaggcgaaacgtagcgataactgagcatgctggtaaaagggccgactgttttttccagtgttctgccatataagctgtctataggcagtagcggagtgtcgctacgcgttacctccccgacccctgccgattgcgcccgggaaaggccttgagttgtgtcaaggaacaaggcttatgaagcccttcagacatatacacgctccttcttgtgacatcgtctacggtgtggtacctgctagcatgttggcatgatttcgatgacagatttgacgcgtgtgtccgtgccacctcgctcttcctcctgaattccggtgtcctacttttatctcccccctcccctttttttgaatggaaccacatactcagatg

SEQ ID NO: 8206 - DNA, 700 bp, Nannochloropsis_gaditana
ccttctctgactttttcttccacaaggaggagacagaggtcaaaagacaaaatgtgcacacctatcccccctcaaaatcacacaaggagtcatcgtttcttgttaaggtggacgtccgcgtgttgcatacatgcatcgtgttgttttggggctcgttttggtttctgaaggtggtaagcccgtatggagagaggaaacagcgagctgcttgccgacctcccccaatgcccaacgtttgatgctgacaacttcaagaaaagggaacaccacacttgtaggagtgcatgcctacctcatgcgtaggaatatggcgagtgtgtgggggttgtagtgcctgtggtcccgggtttgtgtctttgtcgagggcatgattcagtcctggaagagggttgccaggttacctaggggttaatagagagtccttttggatctcaataaaacgcaagtctttttccattttagaagtgaatccaaccattaaggggttgccgacacactttgagaaaagtggcacagctttgatggcgtgcaaacgtctaggcatgctcaaacagtgtacctttcttttgggtgagaccgcaattcagcaatccagctgcgctttatcttactggttgacacaaccctactctttccaataatcaaccccatggactgtgggcacaggcttcttcctagccgcgacaacctgaccgcaatg

SEQ ID NO: 8207 - DNA, 700 bp, Nannochloropsis_gaditana; identical to SEQ ID NO: 6039

SEQ ID NO: 8208 - DNA, 700 bp, Nannochloropsis_gaditana; identical to SEQ ID NO: 6040

SEQ ID NO: 8209 - DNA, 700 bp, Nannochloropsis_gaditana; identical to SEQ ID NO: 4445

SEQ ID NO: 8210 - DNA, 700 bp, Nannochloropsis_gaditana
cgaaataaattttacgtcagaagggcttttcgtcgagacttttccgccccactactcaattttgaagcttgctgactcccatcacactccttgtcacacgttggactcccaaggttcagttcttttcgcctcgggcctcaggtgccctcccagaacgctcacatacatgccgccacgccctatgacccctgatttccacatacccgagcctactgctgccgttcgcgcactgcctatcgccactttgctgccctctcagccctgccttgcccctgagctgttgccgcggctttccaacgcctaactcagcactcgcctggcgcgagtggtgctaaacgagggggggaggtaccttgactatggctgatgggtggaaaactgggcgaaaccaatcaattaccccgtgccttgcatctaaatgccataaaaagtacattaaaaaaagaggagaacgtgatttcgatgccggaatctaccaaagcgtaatgttttagtcgttggagaagaaatttagagagaagctcccggcattgtaaaacctgatgagagcccgctctgaccaccctccacttctcgcgcttctaatgcattcaaaaactgtttctatggtctccaccttgtgagcacagaattttaggtagcggcagagtgttgacggcttgaggttttccaatagggcagagggctcgaggtcagcatg

SEQ ID NO: 8211 - DNA, 700 bp, Nannochloropsis_gaditana
ggacgctcaaacggcagctgagtgctgggacggaggagggagagtcccggaggaactgaggagggaaatgcccgggacgcaggtagaggaggtggtaaaggtgaagccgagaccatgttcgttgctccagtgtgacttagcacgtaggattatggtagggacaggatgttgcgcacccaagcgagtaatgcgagctcgaggaacaccggttctcgggtgcgtacctcctgccaagttggtggggcctaaaaaaaaagcacgtgctccacgtttagtcaaaggaatggtctaccacacgatgcggacctcacacatgtgtacgtcctcccgttgcgtcctgcttggtgggtgtcggtgggcaaggtggatgagatgaaacttgccttagatatagccgccatatcactggaggaggaggttaaaaagtccttgcagagcagtatggaaaaaacaaacagcaggactgcatcacagtagttttcgatccaataatctcggaatcgtcatttttgtacgtccataaacacaggttgacagggtcgctgctttgtgtgtggccataatcatgcagcgtttttggccatatttattcatcctctcgcatctccatgtccttctacccaagtgtcttggagcgggggatacgaacgttttattgctcaaccacgtatcccgcgaatgccgcaaccccgaaacaatg

SEQ ID NO: 8212 - DNA, 700 bp, Nannochloropsis_gaditana
cctttagccaccgtgtggccggagcttcgtgtgcaataaaatcagagaagtatcctctgggcctacgatcgatctaggtacacgactcgccgtcgaagttgcactccctacgccacaggtacgtacctaaataacaatcgctgtcagacgtactctcgtgtcgcgccgtgctaagctgattgcacccttcgcctggcattcctcttctttactgttttcttcattcatcaagcaactggggggcactgagatttatcccaggaatcccctttgtgcccttgttgtggtgcacgcttgatggcaaactctcggacgcagtgcactgagaagtccgttctaatactttgcgacgaacaagccagacgacaaccatctgaagcacccgactcgtctggaaacaagagattgactgtcaataacggatctgtcgcaaacaaaaccgtgcggcactctgatcatcgtgatagttcctcttcgagtgacgcttcgatcacttccccttcctccagccatacatcgattgacgaggtagctagctaggaagggggcgccgtaataagggccaatgtgtcaaatatctccgtgttttgggagagtccaaatctttgggcagtcggtacagcccaacatatacatttctatgcatcagtaccactaacctctgtctgataatttttctacttccatacctttttgaaag

SEQ ID NO: 8213 - DNA, 700 bp, Nannochloropsis_gaditana
ctttgcatcgagtcgctacctgaggcagatgaaagaaggaccgcatggaaaggcatgacagaccaggcaatcagccaagaactgtcgagatagtagaccagtgggttcatattttccaccttctccatatccccatcatttttcatcaagttccctcaccatcgtcccataaacttttgcattcgcctatcgaggtctccgcggactggacggatgactccaaaattcaaattcggcgatcttcttttaacggatcgggaattccgttaaattgaaccgcttcgatgctctacctgcatttggaacgcaggataatgttgtttcgtgtcgaaatttgagtacctgcacagttttgatcacagtttatctgtattccaactggtccatccaaaaacagctccctttagccaccgtgtggccggagcttcgtgtgcaataaaatcagagaagtatcctctgggcctacgatcgatctaggtacacgactcgccgtcgaagttgcactccctacgccacaggtacgtacctaaataacaatcgctgtcagacgtactctcgtgtcgcgccgtgctaagctgattgcacccttcgcctggcattcctcttctttactgttttcttcattcatcaagcaactggggggcactgagatttatcccaggaatcccctttgtgcccttgttgtggtgcacgcttgatg

SEQ ID NO: 8214 - DNA, 700 bp, Nannochloropsis_gaditana
aaccgtcacaaaaaagtttctcacatcggctatcgaagtgatgcggccgccatctcacggcattaggcgtacttgtctctgtgtggccaggtgcaatgtaaccgttacttgccgtagttggaaaaatgttacccattgtgcctgcgctcacggtggaccgaagacaatgagtgaaacttgtttgcctagatactatggaggcgtacacccggtgcatgatcctcaaggcagtctgcgcacgacaaaacatcctcaaaatggaccgaaaagcggcttggaacaggaacaacgcgttgccccagcctcatggtagggcagcgactgggtatcatatctgtcacgtacgcctgaaattctgcagcctgatttctcgttgcccgactgctggccacgatgctttcgttgaacatgtgaggggatgtagactggatgcagcttggtggatgccttggctaaggagtcaataaaaaatgtagctttttcaagaatgcacgggtcgaagcgcaatcagagtatgcagggtggtgcttggtgaatgttgaaaaagatgttctcgtcgtcttgtctctgctataactcccttacacgctcttacaacaccgatacaggcttcatttggtgcgctttgagtcccgtgcgaagtccttgataactttgcccccttaagcggaagccttggtcttgtgttaaggtcgctatg

SEQ ID NO: 8215 - DNA, 700 bp, Nannochloropsis_gaditana
tggtctccttgaaagccccatccaggtaattgagaccagattggagtttgttgaacaaagactgcgacatgacgacccgctgctgtcgtaaaatgaaccactgcgtatgccctgcaaaatcacgtgaaagcacaaaaatcagctatcggtagctatattgtttaactaaaatagaaggaaagcataaaagaattttcttcccccccatggaggacatgggcggcccttggcgatggtccatgaggcatttgcgccccgcttgatgaatttcaatgcactttgcgaactagctcccgtcatgcgcggctccaaaggcgtgtcataaacatgggtgtagtgaaagctctatggatttggaagagctttgccacgccttgcgaaaacagaattggtcgagtcctttgagtgcttgctgcagctcggcttcgatttgtcgacctaaaatgccatttgtcatgttgtacgagggcaaactccttcctcccaaggaagttttgtctgcaatattttcgacgcgcgatacagtttgtagtggacatgtaaagggcatttctttcgtataaaagtaagtccctacagccagccggccgcgctttttcttcatcgctgaggtaccttcaagtccagtgtattgctccctccgcttcccgtgagctaaaataacacaggcaatattcgacaggaaatcaatttgcccatg

SEQ ID NO: 8216 - DNA, 700 bp, Nannochloropsis_gaditana
tcttcttagcaatacgagatcggcactgatttgactttcgcttgtgaaatagatgctatcggtgtcccgggcaaagccacatcgcttgatacgacagcagagggtcaagagactgatacttaagtggattgaagctgccgcaccaaagaacacgaatggtactactgagtatatgaaagaaaataagaaagcgtatgcatgataaagtaattttcgctgtccgttttaattaggtcggataatttgcagtcttataagcgtgcatgcaggatcccgtctgaggtccatttgcggttttgaatgctccaggttgtagtcactattgacatacaagtttcttggggaacgcatgtcgctttcctggtgacaacttcaccttgagactgtccggccgtgccctcgatgagacacggcttgaccgaagttttgtggcggagcaactcaatgctcttgtccgaaagatagcgacgcatggggcactagggaagccactcatccttctaatgtcttatatgatttaaattatctctccatggatacattgcaccaattcaaaaaccataatgggccttaaagctgcaagatgccctctccctgcctctcccgaataacctacccggagctctcccttattgcaagtataagagcacccacaatttacactatgcctccacaggtgaggctttgaagaacacacatg

SEQ ID NO: 8217 - DNA, 700 bp, Nannochloropsis_gaditana
ctggtcaagaaagcggtggagaccgcttgcacgtatttgcccctgatcgaagccgctgcccgcctagtcgcagaactggacgtgcttgtctccctggtatccccccgccctcccccacttcctctcgcaccctggccctctgcccctgcctgccagtgtttcctgtcacgcgttcccacgctcttcttctgcctccgcttttcccctccttccagggccacgtcgcagccatggctccctccggctaccgcaggcccgtccttttcgggaagggggggggacaaggtcagtcgtgccgggacgcagaagggagggagggaaggagcgggacggaggaaggagggagagaggaggggcagggtggagttctgtgcccgccgatgccagtgaaggggcttatgtggttgtagaaggtattgactgacgtgcttgttcacttgatatcgacaggcatcatggtcaagggcggaaggcacccttgtttagagctccaagagagcgtggagttcattcccaacgactacgttttaacccgaggtagctccttccttccctccttcccaaccgtttttcttgtccccttttcctcccctttccctaaatctgcctgcactcgcacccctactttcctcatcaactttcaccctcccactcttgccaaggggagagtcatttcaccctcttgaccggtcccaacatg

SEQ ID NO: 8218 - DNA, 700 bp, Nannochloropsis_gaditana
  misc_feature (84)..(93): n is a, c, g, or t
gtgcgagatcctttccatcctcaagaacggcgtctactttaccaccgctcccttgaaggaggcgtcgggccgttttctggaccnnnnnnnnnntccctccttccctccctccctccctccctctttccccttctttgtccactcttctctctggttcttcctggcaagccccccttttcaactgccttcctttcctctacctccttgtcacctcggtccagtactcccacaagcagagcagcctggtcaagaaagcggtggagaccgcttgcacgtatttgcccctgatcgaagccgctgcccgcctagtcgcagaactggacgtgcttgtctccctggtatccccccgccctcccccacttcctctcgcaccctggccctctgcccctgcctgccagtgtttcctgtcacgcgttcccacgctcttcttctgcctccgcttttcccctccttccagggccacgtcgcagccatggctccctccggctaccgcaggcccgtccttttcgggaagggggggggacaaggtcagtcgtgccgggacgcagaagggagggagggaaggagcgggacggaggaaggagggagagaggaggggcagggtggagttctgtgcccgccgatgccagtgaaggggcttatgtggttgtagaaggtattgactgacgtgcttgttcacttgatatcgacaggcatcatg

SEQ ID NO: 8219 - DNA, 700 bp, Nannochloropsis_gaditana
atattacaatttgtcttgaacatttttgccctcgaggccccaaaaaatgtcacaagtgtctttgtcttataagaaatgctacatacaagcgactgagaaaaaggcattacacttgttcaatatctgactcgtttcgttcacataaaatcttatattaattcttgaatgcagcttcatctgacattgtagtggaattttacgttatagcaaaatttttaatcatactagcaggaagggtataatgtgtagagaagacggaatgcaactgacacgcctatcgtacacataattccgagaattaggggaaatatagaatgaacatgcacttgatcggtgaaagcataaagcattcaaatcaggaaactgtcacattttccatttctccgcgaaggccgggcacaagacttttccacattttctgcttcgcacacgtagggaacaagcgagggcactacggcaacaaactcctatcgtctccaaagccgcggtgatgaatgtgctgacctaaactatgggagaaagttcagggtcatgggagatcgtgccggagcgtatcgtggatggcgtcacgatggatggacggccttgaaatagaacgatactctacatccattacgacacgtacgggatatcgcttatcacgaaatccacattcctctcaactatcttcatttatagcctgccgagtgctcaaaggatg

SEQ ID NO: 8220 - DNA, 700 bp, Nannochloropsis_gaditana
  misc_feature (1)..(601): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcaggatagcctgacctggagacgctggctgcgcggctacttcggcaacgcgcagggctcatcgacatctataaggtctcgaaacgcacgatccatg

SEQ ID NO: 8221 - DNA, 700 bp, Nannochloropsis_gaditana
gctgatgtatccaatccttgttatacgtaaaccaatcctgacgagatgatttccacggaaaggcagggaccggaaaaggttaggaggtggttaagacctatcaaagtcgattacattttctttgctcctgacctgcgcataatccagccagaaaaaggcaagcaagacaataatggcaacaacatcacccacatttacgtgcgtgatggatgctatcaagttttggcccatatgtgataaaagtcgggcttcggacgctagcttcgttccgtgacgcgggtgaaagctccgctggcgggtgggttcaaatttgcaatttctggcctattggagtgattcatataattgaatacacgtgaaaaattacactatggaagtggaggcgacaatcagttcctggtcattgccctttcggcgtgagggtttggaaaagggaagactcgactccaaagcgagggctctaaaccgtcgtaaacggtcgctaacggctaaaccaaagcaggtggcaaggcgtggtgcatcgtcaagacggggtcatagcgtgggacggttgagggtccattgatcgacttatgcatcttgtatgtagtttgaaaatttgggccgaaaatgacggcatgggcagcggtaggtacgcatgcaacattaatgcatccctttgtgttcctgcattcatccttggacaggccagtccaagatg

SEQ ID NO: 8222 - DNA, 700 bp, Nannochloropsis_gaditana
  misc_feature (505)..(690): n is a, c, g, or t
cccaacccatcatgccctgttccctctcagctgacggtctcggaatcctcgcaagggaccgcattgcgtctggagtacgcggtagccaagacttccttcaagaggtgagagggcaggagcagggggaggggccgaaggagggcgggcgaggcatttcgttaaggtcttaacgctcctagtgcgtggaggaggagcgaggaagaagaacgggtgggagtgagggaaggagggagaaagggatgggggaatgaggcaaatatctggtcatgaatgatcgattgaattgcgagggagcaggagaggcatgagggtgggaggaagggagggaacaagggagggccttcttgccccaccgagcgagggagaggagagagggcggggccggcgcccacacgcgctgtgtttggcttcccactcctgcggttgcgtcctggttgtgtgaccgtcctcgggatgggatgacgcatggaggtagagatcgagaccccctggctctcttcctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcgcgtg

SEQ ID NO: 8223 - DNA, 700 bp, Nannochloropsis_gaditana
gaaaactaggcctatagcgaggcatggttggccgacgtgagaagcatcatcaccatgaccagtctgttcacttccaaacaaactttgaatgtacgtcatctgcattatgcaaaagaattggtggtttgtcaacttttccacttatgtgcccgtaggtgtcgagcacctgcctgtcgactcagggtacctattcaatcacatcatcatcgccaggcctatccaggtaccttttccatcgcatcatcaagattaagtccccccttcgttctttgggcccctttgaaacccccgggtttggacgagcccgctcctgcgggggggatgcagcctcatgcgcaagtgatgattgacgaccgatccatcgtgtattttctaagaatgaccaaatattggacggggtggtgaccctgccttcaagatttttccaggtatcttttccatcacatcatcgtcgccaaaacccgcagcagcgacgtttactggtgcctgtgcacgtccatgttcaaatgtgaggctctatgaggaatcttcatgttgtgcatgggaacctcagttgaatcattttttaacgcgacgctgatctgtaacttgctgcgttgggcaggattttcttaaccccaattcttcctttcaacaccgacgtctctcattttgtacgttagacatagggattgtgtggaagctccttgagcgtaccatg

SEQ ID NO: 8224 - DNA, 700 bp, Nannochloropsis_gaditana
gcacacacgaccccatttcagctcaagtgtcgagtaagcatgttattgcattgatatgtgcagaggaggaatctgcaggaggacgcatagtacctcaaatgtacgagtagtacttggggctcaaggacgctattctttggttccgttggacacgctcctcctccgtgcagaaggccacaaatgggccgacgactcgaaaggccagatacccaacccctagttttacgatctctgaaacatccatgttgtcgtttactatggctaaagactagaatgcaacctcatcgtcagtttgaagaagaaagctttcaaacaattgcttccgatcccaaaggattgcatttcagaggatgctcctctctcggcctgtctcactttgacgccatcgaccttcgagtgtaaggaacaagccattcatgtttgaaatgcgtccaactcccaccacactccctcagaccacgagtacatatatttaaaagcatgactccaccaagcatagaaaggccacgtagaatgcgtgcgcagaagacccataccaagccacgaggaccctgcagggtccgaccgttgcgacaacgtccaaaccgttacaaaagttcctccgattcaaattattgcgcgaacgcgagcataccatggcaagatgctccccactgcgtggcgttcatgccgcacacaaagacagggtcaaggacgcatg

SEQ ID NO: 8225 - DNA, 700 bp, Nannochloropsis_gaditana
tgacaaatgcgtgtagtagtctttcctctatctttctgcgtggtgagctgcctatgggacacgcatgaatggtcgtactgcccttaaattttggacggtattttttgcttcgggtgcaccctacttgcggacttgaggatgctcatacagtcagcagagactcgttaaaaaagttttcccatcatttcttccgaggacttaagtggtgagaacgtggtcagcgatggagcagctccttttgcggatggttgagcggcaccgggaggctttgtgcgagtcgatggataccacgtggaaggagaacttgatttttccccgactgcgcgcctgtgcataataaagccgaaggaaaaaatgcgacgctcggctattcgtagagctgaatactacgaccaggacagacgaccacgccagcatgtggtaaaagaccatgttcgacacaccatgtttgcaacattgaaataaggtcactagcatgtcaatcggaataatttatatcgcaacactctgagcgttgtgaagacgcgtcattttatgaaaatccgacccaacaagcctcctgagcaacaacctctcagcttttccattttcacaatcctttccctcccccgccgcaataacgcctggttggaacttaggattttcttccctacgtatatatattgatcgaaaacatcaatttctgggcgctttgaggatg

SEQ ID NO: 8226 - DNA, 700 bp, Nannochloropsis_gaditana
aattggaaataaaggatgccttaagtgtatgagtcttttagtcctgcgattttccggtgaggtgtaaagctcaggcgaccgcaagtctcgctcggaaagcccatcgctgtgtatgatgactgtatgtaaatgtatttcgttttgatacgtcattcattcaagaggggacaggttccctggatgcctcgaaagtgtgtcagtatgattacccttgctgacttcggtagtggggtggggaggttaattcagatctggttgcacgaagacgcctgtcttgggagccatttcgccgccgatcttatcattcattatgatgtacccattcatgcatcccacctatcaacaagcagatgtcaaaccctctaatgtgggagtgggccaagcagttgccgccttttgtgagggaaaaaggatggagagcgaaagcgtactccaagggaaatgatctccaagctacatactatcactgctccctttttgatattccttctacattctggttagagatgacagagaaaaatatagaagcggaggctgatgggcaaaaagacctggcgacgaggatggaagcgtgcgggcttacgagggcggagggtgatagggaggacggtcgggagatactggagggagaggaagaggaagaagaaggaggggaggggggaatcgagggaggaggaaaaaagctatattgtcgaaaatg

SEQ ID NO: 8227 - DNA, 700 bp, Nannochloropsis_gaditana
ggcagtgtggggggtgttttttgggaaaaaagtgcgcgacttgtcgaagcagatggtggacgagttggccaatgcgggcagcatcgccgaggaaagaatctcgaacattcggacggtgcgagccctgggaaacgacgagctggaagtggggcggtatgcccaccagatgaacaatgtcttccgggtagcgaaacacaagagccttatgcaaggtatctattacggcgtggccatggggtccgggaatttgggcatggtgactgtcttatactttggcgggcagtacgtgagcgaagggttgatcaccgtgggcgatctttccaccatgttgctgtattcggtgtacgcgggcttttcgatctcggcgctcttgtcgtactacggcgatttgatgaaagccgccggttcggcagaacgcatctttgacctgttggagacggagaaaacaccatcgcgaggacgagtaacaccgacacaagtgctcaaaggagcaatggataaggaaggatctcggatgaagacctggcctcaagttcggggacccctgatcttcgagggcgtgtcttttgcctaccctactcgccctgactttccaatttttcaagacttagacctggaagtgcgcgaaaacgagaccttggccctggtcggtccctccggtagcgggaaatcgtccattgctggtctggtcacacgcatg

SEQ ID NO: 8228 - DNA, 700 bp, Nannochloropsis_gaditana
cgggggaacgcatcgctgcccgcttacgaaagcgggtctttgcatccgtcgtgcaccaacgcctggctttttttgaccggtcggggacgggcgaggttatgaaccggctttcaaatgacgttacccaggtggctaagacgctttcggaggatacaagctatttcctgcggaatttcgcgcagggggcgggggcgttgggcatgatgctttacacttctccacagctctgcgccatcatgctgggtgtgatcccccccgtggcagtgtggggggtgttttttgggaaaaaagtgcgcgacttgtcgaagcagatggtggacgagttggccaatgcgggcagcatcgccgaggaaagaatctcgaacattcggacggtgcgagccctgggaaacgacgagctggaagtggggcggtatgcccaccagatgaacaatgtcttccgggtagcgaaacacaagagccttatgcaaggtatctattacggcgtggccatggggtccgggaatttgggcatggtgactgtcttatactttggcgggcagtacgtgagcgaagggttgatcaccgtgggcgatctttccaccatgttgctgtattcggtgtacgcgggcttttcgatctcggcgctcttgtcgtactacggcgatttgatgaaagccgccggttcggcagaacgcatctttgacctgttggagacgga

SEQ ID NO: 8229 - DNA, 700 bp, Nannochloropsis_gaditana
atacggtcctacctgtcgtcagtattttttcaacataattatcctcaagtagtaccgcttataattcggggcgcacaaaacctgagcactctcccgggcaccccatctagcgcttccattaaccctcggtcgaccacgtctacatctcatgtaccctcagagaagtctacgttggtcgtgaccgacccgtcgcccccttcccgtcccgcccggaagacctttcaacattttctggcccttgcccgtcccgagaccccggcattcctgaccgccttggcggccgtggccgtagggacagggacgacggtggtctttcctttcgcgatagggaaatgcatggacgccatggccctgggaaacacgaagcagctggtcgacagatccaaaggcacggccgatggcaccctgccggcaattgacacgacagcggcccatcttagcatgaacgcgagtgaattcatcgaggcaagctttgggcccggcgtcataccggcttgggccatggacctcattcctccggatgctgcgccgctctccgtgttgagtgcgggattggtgggagtgtttgtggttggcgctctggcaacttttgttcggaacaccacggtgcatgtggcgggggaacgcatcgctgcccgcttacgaaagcgggtctttgcatccgtcgtgcaccaacgcctggctttttttgaccggtcgg

SEQ ID NO: 8230 - DNA, 700 bp, Nannochloropsis_gaditana
tcgccaatttgatgaacgaaataatgaagtgctagaaactttgttggattgatcctctgtgtattgcttgtggactcttctggaagtgctgcttatatttgcctgaaaggtaaaaatgccactacaaatgcaaagcgctaaaaatatcaagaaattcatacaaatgacatgcttgcaacgtgcagaaaaggtttttgaatgatcgtaggattgtaaatttactcgttcgtccaaaagcgaggaagcaggccgtgagacatgtgcacgcctccgcatggacgagttgtgttgtgacgaccacatggcgaaggctgctgtgttataggtacgtcaagagagccgttatataccaacatttgtccattggagagtgtcttagaaacagaaatttctaccaagacacgtcttttacctctggttcgttataccacgacaccagcagcgaaaccgttggaaaccgtttggagccgttgaaaattttgacagataaaagaatcgagagaaacggccagacccagccccgcaaggaggaaatgtctacatagcggctaatttatttatatgtaattgcttgatcaatgtccatccagaatattacataacatctttatatacatctatgagtaacttcttatctctatgcataaaggacagtacgctgtcacgaaacacatttgtttctggagactaggaaactatg

SEQ ID NO: 8231 - DNA, 700 bp, Nannochloropsis_gaditana
cccgtgccaaaaaatggcgttgacaaaattatcttctgcatggctgcgcggtatatctgtatagaaatacgacgtatgttttgtgtgtcgagacacgactaggggcgtagcatgtttttaatcggattttacgcgactacaggcgccaaaagctttcccttgcccatatgtcttcgcccgcccgaggacacgtcgaaaatatgttagccgaccaaacagaaggcagcgacgacaattggctacgagacttccgagaaatgaagcagtcaatactgatgtcgcctgcaggcacctcatcgacaggctttccttccccagcacgccgcatatcagaggtagaccctgcggccgtcaacggtgatcatttagatcaggaaattaaatctatcgtagatattcttcaagacgaagatgcagcgaacaagaagttgaatattggcagcagccatcatcccgtgatcggaggtaaagaaaaggcaattaagggtccgtacgacagattgactgggtgcgcaccggcagccagtcccttgtcctcttcctcctcctcctcgtctgaatcgtcccgtgcttcctctccagagagcactccctcgccaggccacagcggcttcaaaaacagcagtagccacgaaagcagctgctacagccctaatgcctatcaaatcctccgcagtgagcagcctctggcaccaccctt

SEQ ID NO: 8232 - DNA, 700 bp, Nannochloropsis_gaditana
cttcgtcggtcttgtccatattcctgagctctttccagcaggttgccgcttaagccgattttctcccgaaccgcgtcttcatctctctttgcaatttgctacgaggtaccgcggatggatagctccgcgctattgaagtacgctgagaaaatgttatactactagcgcctgtgtggtatgggttgtgccacaaagatgatgagcgcaacagtgtgcaggtgggtgggtttacgtgaaattcgtttgaaattatagtcacttgcggatgcccgcaaacttgatatgaaaatccgagtgtattacatgccacgtgcgtgcacgtaagtttgcgggcaattagtcgataggagggaagaggcatgagggcatgattccgagtcgaggacaggaagagaggggttgaggagaaacacggagacggaggccatggccaccaggggcagaagctgaccacgacgacgagcaagaacacccctgtcaggcctgggcaagaatgtttgtgaccgcacgagcctaggcataatttgctcctcttatttcccgcacatgtgtgctgcaagtctcctcgatcgcaagaggccaggctcacggccccccccttacgaccctgcctgcgtgcggtcaggtcatctcagtctactgcaaggcaaatctcacaggcggcaccaaacatgtttcttcctcaaacctcatacagatg

SEQ ID NO: 8233 - DNA, 700 bp, Nannochloropsis_gaditana
gtacgtgatgactgggaggttattggtgtgttctgggtcaaatgaactaacattgataccacaaatgcaggaggatccaacttcgtatagcacacatttttaaaattcgagaagtattataaatctatctaaaaaattttggctggagcaatagcaagggactgttaactcggagtgagcagaacagcctcgggtgctccctgccgaggccggagagggctctctctcgcaacagcggttttacggttttacccgggggaagatgcgattcttatttctttcgctctccatgtcaagccctagcttgcctggcgttgacatcttagatgcgccggcgattgtgtcgtgtgacatgatagtggccataattttgaaagtgggcgagaaaactttggcggagagacgatggcccgccttggaggccgctagctaccgcctttgactcgcgtgcccaagtccggcagaacataatcatcctatagagctggtttaaattggttagctcatttgttcttgatctcatggagagacatcggcgcattgattgtgtcccctgacgatgtgggaatggtgggatggctccagggcccaacgcataacgacgatgacggctctcaagacgttccacccatacatgcattgatcaggcaccggagacagaaagcataacatccgccgcgatcgatccagcacgcccatg

SEQ ID NO: 8234 - DNA, 60 bp, Nannochloropsis_gaditana
cctccccaggcgcccctccccccccctctcgccttcgacgaggacaccctttcggccatg

SEQ ID NO: 8235 - DNA, 700 bp, Nannochloropsis_gaditana
atctcccacaacaagcgacggcatttcctttgctgaagtaccgtcatcggaagtggtagccattgagggtggggacgcaaccatcgtgcgttttgactcttgaagggtgtgtacgcggcatgccacatttccaaggaaggaggaattaggcaccggtgggtaaaacgtggtgtggtgagaaatgtttccgccgtcacaatctagcccagctgtccgaccagcgtggcctccaagctatgacatagagacagggcacacccaaaaggtcatccacatggaaagctgtcgagaaacctcggcaaatgtgagagacggaacgcagacgaataaggtgtgtcgaggcgggaggtcagtacttgaagcagtcttttctcgtgttcggcccctctgggacgacgcgtcgaaaattcaagtggagcaaccatacaaatggtgtcgagcgccaccatcagttcccatattcctaatagttgtgaagtattcccttggattgcgggatttcggcgtgtgtggtgaggaaaccccctctttaccaaggcagggtcagggaggggcaggccgcttggatactccaccttttccccccgtacacgacgagactattctcaacatccctcgtcaacatccacacgcacgtgcgtattcttgcacattcttgtgcttgcgcgcgcaggtagcgctctgcgaagacagcatcatg

SEQ ID NO: 8236 - DNA, 700 bp, Nannochloropsis_gaditana
agtcacgacgtacgcaagcctatgcttcagggagcgacatcaacccccccgggagccactcgttggttttgtccgcctctaccgccttgcctcaaagcgtttcaaaagctccgtcatgctgcaaccacacatttcgcacgcatatggctttcgccatcgttttttaagccgcccagtcgttgggcagcacgacgcacgtggcaggcccggtcatcgctgtgtctcgaatccaggggaaggcagtgggaggatactgacaccattgctcgccaagcccctacggtaggaaacgcgcccatgtccggggtaggggcgcctttgtggttgaaaggaagtcgacgacgtgttaaggctgccgagatgtgtgcgtgcggaggtttgatcttgcaaggggtatacttgggaattgtagtgacccgtagcaatgagagcacgcctgtgcttttcaacctcctccccctttcaagggagggtttatggtaaccgcgagtctataaatgtagatgtaatcttaaccccgcagattaaggctcttatcattcatagatttttttataatctctcgctgctctgacagcttgaattctcagagatgtcacatcgtttgtatgttgttccttaatatcttctctctccctctccctcctccccggctgcaacactaatttaaggcttgcggacacaaatcagtaccgacatg

SEQ ID NO: 8237 - DNA, 700 bp, Nannochloropsis_gaditana
ggatgaaggcgacgagaaggaagaaaatggcgaataagagggcaggaagcttaacaagccggactgtagctccaggcatggtctggctgtgctgcgcctgtgagatttattgagtgaaagcaatacttatatatacatatatatacaactgtatatgcatgatacaactgtttttcttgagaacgacgactggcaggcaaagcttggtggtagctgcctgtaattcaatgtgaccacacacgagaagcaagcaggggggaggttaatctttttatccttccaaagtaccgatgtccactctcactacgaacatgtcagtatctgctcccgaggttaagaacagcagtgccatgagaagagagaaatgatatgaggatgtccttcgtcttcagatatgcctcatattgaagcatattgtggcggacctcggtagcaggcatcgaccttgtgcatcgccgactttcgttttcgcagtcctgagttcgatgaagcgaattcacgtctcaaccgcacttcagcaacaaaagagaaacattggacgagatcagccttaacagctgcgatatttgtaatactttcctcgaaatgcggtctgaagagagggtgaggccactggtcacgtgctcagatgtttgtactttttggataaagaaagacagaatgtttgcctccagaatacaacggagccttaatctccaac

SEQ ID NO: 8238 - DNA, 700 bp, Nannochloropsis_gaditana
ataccgtagagacctgcccctcccgcgtgagagaacgacccgcctctctttgcacgacctcaaccaccgccaggaggtcggccaccgccttcccgccctccgtcccgccctcccccacttcctcgccctcgaccaaggccccggcaagggcggcttgctctactacacagcccatcaggaagggagcggtggctatgaaagaggccgactcgacctccttccacagcgtttcctcccacagaagaaacctcacatcctggtcaccgcgcccagcaacgtggcagtcgacaacatcgtccttcggatcatggaggacggcttcctcgacgggcaagggcgtcggtacaatcctccccttgtccggatgggccgctttgggagtgaaaaggtgcgtccggatgggccgctttgggagtgaaaaggtgcgtgtacatgttgcgctttctgcccgttgggttcgacccaggctgtagagaggcggaggctgtaggctctgggcaaaccagtaaagacggatgcaagctgagggtacctggtgaacatgcgtccttcggtgggagaggccagatatcaaagcaatgcttgccaggcccgggccggttccagccagccgacttccggatgtattcacagagcgactggaggagggaaagggcggtgcactctcagcacttttttatctggaatgccttcgatcatg

SEQ ID NO: 8239 - DNA, 700 bp, Nannochloropsis_gaditana
gccaaggtgtcaccctcggccagaacaattgctttattgatttcgaaagggctgagaactggcttcgcagaagatgatgagatagattctgaaccgataacagcggagctgaggatacgatatgcgggattagccagaggggagagtggcagcacaaacgctagagagctttgcagggctgatgccgcaacaaggaggaggagcaagcttactccattacaagttttttttttaatgcctttgtgaaaaaggctccatcgaccctttctcagcttcatgtcggtttgcgtgctcatagaagtgtttacggctgtcctatcatctgtaccaaaggtgacctcctgcctcacgccctgttcacaaaaataaataagccagcaagtcagagagagggagcaaacgatgggaaatgacagctagtattttaagaatatttggatgacacagcggctgtgaaagatccggtgggacgttaaggcacaagagaactcatggacggaataaaacgtccacggcgtgtcatcttactgcaactagcgagcactgatacgcagactgcagataaaaggacaaatggaaaaaatgcaattttcgattcgagctacactgatctcgcacctgtttcgattgtttttcgccatacaacctgcatcaatacaatggtgcgataatccacgtttcgtttttgatccgcaacatg

SEQ ID NO: 8240 - DNA, 700 bp, Nannochloropsis_gaditana
atgcaacgctccctttctcttcgtccttcgtttttctcggcagctttgttttcctcaaaatgcgacctagtgtaagaccttctacctaagccatacgacgccggtcatcggagggttttggagcaagtgtgactcatggagaacgtgaaaaaagcaagtccaggagataaagaactgagccgtattcaaaatgattttccaatgtcacaggtgcacagcctggaggtgcccgaaccctcgaagaagaaaaaatattttatgcgcgacctgatgacgcttgcacgctttatatttctaggcctcctctagctccctgcaccccgaattcacatcatttttttgtatataataaccttaaaaacatagcagatcctacgtaatactactattgtcagcaagcgttttttggacgcggcgtttacgtgcgcctggtttataacttaccattttcaatcccaaggccggagcaaccgttgtgacctcaaggaggcaggaggttcaccatacaacgcaagtgagcaagtcatcattttccctttcctacaggttaccgcgggatttcatggagcaatgcgtgtcgagtgtcaagttgtgtcatcgtcgcaagcttttatccgctcaaatagcatactgtgtccgaaaaggcgtcaaaatccgttctcttcatgaaaagtacgggggcaacgagggcacaacaatg

SEQ ID NO: 8241 - DNA, 700 bp, Nannochloropsis_gaditana
  misc_feature (1)..(643): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggctgaggaagcggatacgtgggcaacctcccctcctccgccaccagcgacatg

SEQ ID NO: 8242 - DNA, 700 bp, Nannochloropsis_gaditana
ctggcgctggccacaatggccatgtcagtcctgacaactcaggcatttatggtgccccgcgcacctctccctctcaacccttcctcctccacgcccacgcatcgtacccgtgaggtatgcttttggcattttcgcccttgactgcgcatgggtaatcaatcatgcctcaccctttcccctctctcttatgtctcacttctttccctccgcgcatcaggcgcccaccatggtcatttactgatccataaaaagtgccttcgacggcgctctttacgcggcgggcgtgaaggacgaattccaaggcacaggtgtgtggagcggcattaaaatgaagcgggagaaaaaagaagacacgggcgaggaacaagaccagagcagcccgacgcctgcggcctcgggatctcaaaagggggcagaaccagccccggcgcccaagaagacgaggaaagaggacagataagaaaggcggcctgttcttcccgccgttttaaaggcaggaagacgccgacgtcgacatagttcctgtggcgggcatttgaaggacgcgggtctgcttcttctttgcctggtcgacgcccctgtttccctccctctctccttcctcgctcgaccccccggctccccggccctcggtgtgtcggggtccttgttggacggattggataatgacggtcacttctcgccttcaaatctttgtatg

SEQ ID NO: 8243 - DNA, 700 bp, Nannochloropsis_gaditana
tgccttgagtcccccgaaaccttttaaaaagcctggcatcttccatttgatgaacgaaacatcgtcccaacctgtgaaacttggtgtttgcacctgttttggcatggatttacggggatggcatggggtctcctgacgataccgtgtaaaacactccccgtctcaacgtattacctaccacctctgacctgttttccaagtgcgttttgtccccggtgtcccgtccgaaaaggcacacaacttgctgtctttccacggcaaagcatttgttgctttgtttttgatcgtgttacagctttcaaactgggaagtttaggccttggccggtattcagttgtcacttatcaccacgtctctcaccgtccgaccgctgtaacgtaccggtggacgaaaggacagatcaaactacgcaaaaatgcttcatggtttttattgcactcagtcacacattttacgcacattttacacacaatatatacacgcttctttgcacggtgggcagcttgggtttttcccgcgcgtgtactgggcctgcccaagtcagggagacgaacgggcatgtggaagtgacgagcactggttaagagaaggaggtcatggtcggctgcacgcgcagaacacgtcgtacctcgttttatatacagctgctgttccaatgctgcgttttcaagaagcatcggctggggaggccagggatatg

SEQ ID NO: 8244 - DNA, 700 bp, Nannochloropsis_gaditana
  misc_feature (184)..(270): n is a, c, g, or t
aggaggggattgctttcacggtggtggaaggcccgggggaggacggggcgaagggttgggcggaggggagcttcccggagttttgggggggctatgtgggctattttggctacgagctcaaggacgattgcgtgcggctgcagaaaaagggagcggcagggagtttggaagggagggacacggnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagcccccctccccccctccctcgatcccttcctcctctatacccagttacggcgcgagaaccccgccccgttctcgggcttctggcggcatgacccgaggcgtcagctccgcccccgcggggccgacgagggagagggcgaggggggactgagtccaggagtcctaccctccacgttgccggtgggcgagcccggactctcctcagccgtggcaggccgtgggcgatcccgtctatcgaccctcgcccccgccattgccctctgttgctcctcccctgaacgatttctgcgggtggcacgcgccaacggggtggtggagtcgaagcccatcaaaggcaccgtccgaaggggtcagaccccggctgaagatgcccgtttggcggccggtctggctgcatgcgagaagaaccgggcggagaatttgatg

SEQ ID NO: 8245 - DNA, 700 bp, Nannochloropsis_gaditana
  misc_feature (1)..(264): n is a, c, g, or t
  misc_feature (559)..(645): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaggctcgcattgctcagggaggtggatgggcgggatggaagggtccggagggaggtcagggggatcaccctgtttgaacacctccaggctcgcacgcagcggatgcgggaggaggggattgctttcacggtggtggaaggcccgggggaggacggggcgaagggttgggcggaggggagcttcccggagttttgggggggctatgtgggctattttggctacgagctcaaggacgattgcgtgcggctgcagaaaaagggagcggcagggagtttggaagggagggacacggnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagcccccctccccccctccctcgatcccttcctcctctatacccagttacgg

SEQ ID NO: 8246 - DNA, 700 bp, Nannochloropsis_gaditana
aagggcaacggcgggaaaattcgccaaggtactcaatcgatgcttcgcaccaaaccatggccataaacagaaatttcaatgcgtttcaaatcaaaacacacagaaacataccatgcctcaccgcaacagcgctggcaaatggtctcgtgtcccttccatttaacatagtcacggccatttttacgctcctacgtccctgagccctccgtttttagcgcgaaaacgtccgtggcccccgctttctggaacgtcccctccggctccctggccctgggaccgaaactgcagggtttggacgtcctgggatggaaaagtctagtcgtggcgttcctgtgcgaggtggacgtgccttgttttaacgaatgattgggtcgtgtgttcattttgggccttggctcgaggcaacccccccgagtcgggtggacttaagatcctcaccgatttattccctgtcgctgacttggttgccaatgttccagcttgagaggcggactacaggagtccatgctcacgaatccacgctgtctcccacgtgtgcactacatacagagccgggagcaggcggtgccacgagggagggaagcacgaagcggcacccgcaaggaaaaagaagcagtccttcggcttcctagaacccctgtccccaccgttacgttagaccaactggacagtacatcccagcgaaaaaggaagcaacatg

SEQ ID NO: 8247 - DNA, 700 bp, Nannochloropsis_gaditana
aatggacttatagcgcggggagcgccgactcgaccaccgccaaggacaagcgtcaaaaaccagggcccggccctgcggggggggttccggtgccaaacgtcctttccgtccgcacaccctccacattgtcgacatcacagtgccgtgaccaatcgtcgtgtaggtcaatgtggtgttgggaggtaatggtggtggtgaaaatgcttgcgcccctatccgagagccaagacgatctaaagaagcccaagctgacaattaggcgagtccttcccgaccctttttttcccttttttcaaggcctcgtcactgcccgcactgtttgactcatgccccatggttcccgcgtccatggagaagatgtgttcgcaggcatgagtcttgtgcgttgtgcttgacttcttggggggaggtgcttttatctttagaggcattatatgcctagggtgatgagaggctagcgacgtatacgacgtccaaacccgaaggcaatggggggctatttttaacctgctaaaataatgcctttgcgcaaccaccttcctgaacaccaccatacaatgtcaccgagccatagatgtagcgtttcattcatttgtcggattgacacctctcacaaaacaggatgagacagactaccctaacccacaaagccgtgggggcggggcttttggccttggtcctcctcgcgcaagccagcatg

SEQ ID NO: 8248 - DNA, 700 bp, Nannochloropsis_gaditana
  misc_feature (1)..(676): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaagccgggcaaaccatcatg

SEQ ID NO: 8249 - DNA, 700 bp, Nannochloropsis_gaditana
tgggctctcttacatcgaacccttgcttggacatgtcagctttgggaatgcccggtcccaacagggaaatgcgagtttacgagacggccgtgcacaggggctcctccttcgacttgtcctctatagaagccagacagtagatcgtgaatcctacccgcgtccggtcatcgagaaggcgctacacagcaagagtggcaagcactgcctggtctaccccgtcttccaccccgtccctgcacagacaggcccattaatttcgaatttaaatgctctcccggccacacactggtatattcaccacgaacctttttccacatgaccgaaagatgaggctgtcacggttttgggacctcagatgaactaaaaaaatggtgtcgtgacgggctccatagctgtctgctgaatcaactccttggaactgtcgtcacgttcgtcgccttgtcatgtcggaataggagcgccaaggactttgtaaaacacgcagcaattctcatgtctctgcagttcccacattttgtcctggcccggagcaaacgacttcttcatggcatttattttcgtcccgctttccgagacgacttcaatgtcgatgcagatgcacgcacggcaccctgataacgtcacactgcgttttggcagcagcatttcgaacccttaccaaccagaccatggacgtctttacatctttttcagatccatg

SEQ ID NO: 8250 - DNA, 5 bp, Nannochloropsis_gaditana
cctta

SEQ ID NO: 8251 - DNA, 700 bp, Nannochloropsis_gaditana
agttttgtgaagctgtgtaacgatttgttaccagaaacctcttgttaccaggaaacctcttacggatgccaattttgggagaaatactttgaaatttaatagcatgaattcaatagtacaggctataatttacaccgtgtaaagtaggcctcgtcacggtgcgcacccgtttagctggttgtccatcacaacgccagctgctcccctatttgtcgcaagcgttatcgaagtttcacgttcgaatttccttgtctagtagagaaactcaatgtcagatgtcggtgaggtatcgcatttgtctcaagcaggaggagcaatcaacgcagatttagcgctctagaaagatatcaaagatgttgcgctgcaaacaatgtgatgattcagttcagcacgtgtagagtgtcgcggtgtgaatgagttcaaaaggttgcgcataagggcccaatggacgtggaacaccggcattgaagatcgctgaaaatgacgtcatctcctcggccacgcaagcattacttatcttgcatgtccgtgatgagactcatgtctgtactcaggcatgtgtttcatcatctatcgtttttgaccatatagcagactactttcggagacgaggctgtgagatttactctgacggacagacccctgccatttcagtactgattttttttcgtccaggtgataacatcactccttcagcatg

SEQ ID NO: 8252 - DNA, 700 bp, Nannochloropsis_gaditana
catgaaaatatgggatggacatcgtgtttgagcttatatgactttcacatggcccgaacgtgagggatccccccaaaacattaaagagctatcaacaatgctgatgtacgcttctctccctccctaccttcaccctgcgcttctccgtgttggtggcatacattttgctccagtaaagtctttgcactgttgatgtaaaaatggtgagaaaggaacaagcaatttaggcgacaaaactgcagacgagcgatcgatgcagctttccagtcatgcgagtggacgcgaaatgccaacatactttcttcccatgatgcgacatgcgacatcatataaaagtatcgtgcatctggaacatgcaaagccacagcgtcctgccaggaggacgggcgtgccggggactgtaaagtgacttgaaacagacgcgaggtcaattgtcgtccctgatctcgatgttgaaaagctggggtttaatttgtgttgattgctcaactcgtgacagcgtatctcacgtgttttcatgggagccaattttcaatgcgcgtggtttattatttgattcgcagcgtgaagaccggggcctcacactcccctctatcacatcctcttaccgcctccgaagtttcttgctcctccctctccccgacaccctctgctcaacaaaagagctttcttgtgcttcaacaacttgttcacgaccatg

SEQ ID NO: 8253 - DNA, 700 bp, Nannochloropsis_gaditana
ccgcatacgcgttcgcttgctgaaagtcccgacgacgtcgtgcccgcactttgggactttaggcatcgagatgatgatgatacgagctgctaaaaacgaaaaccattaagaaggctgcttattgatgacgatccgaacagctgaaatcgaaaatcgttaaagctgagggcctcatgctgaggccctcaacctgaggggtgaaaacgatccgagctgctgatatcgggacgcctctgagcggacggttgatgacgatccgatctgctgaaatcttggatgataggaatccttgaccgacgatatcagagcctgagttgaacataggaatgtgatggcgcgagcggtgaaatatgttggatagctctagtatcgcatatgtgatttcacggcagtaagattcggtcagagaccgacagtatttccaacaccgtttaacaacgtacggtttttggatacacttagagttttccaagatttgaatcgtgcttcacacacccaatccatgctgcatcaaagcgtcaaatggtgggaaagagaagataggagggaaagcgttgatgaccaatcgagcgcgcagatgagagaggcaggaatcgtttatttcccaatcctcatctgcctcctttcctttgcaatccaacactcactacagagtcaacacatccaagcccgctttctttcacttttcgacatcaacatg

SEQ ID NO: 8254 - DNA, 700 bp, Nannochloropsis_gaditana
  misc_feature (440)..(639): n is a, c, g, or t
ttccccccccaaatgctgggcgaggaggagcttctggtgcgagggcctcctccgcccgccgtggggcccatgactaaggtatcttcaacttaagagtggcgtggagacgcgcggatggtcgttgacgggtctggggtggggtcgtggcaaatgcccttccggtccaggcacctcgtggcaccgcgtccgctccctgtttgtcctttcctttccatcgcatcgtgccagccacggcctgtttgtgtatcactctcccgctctgtggcaccgtgggatgggatgtctccctccctctcacccctgtgtctcggtccttccccccctctctctccctgcctcccccaggaggctttcgcccaggcgcgtatggagagcgaggtcgcggcgagggaggcggcggcggtagtggcgacctttctggaggcaggggacgaccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccttcctccctccctcccttcctcagctggttcctccctccatggcagggaccgcaatg

SEQ ID NO: 8255 - DNA, 117 bp, Nannochloropsis_gaditana
ccctttctccctcccttcccttctagcgccgaccgggacgccctcgcgcgcggattgggcctgccccaaggagagagggacactgccttggtccggagctatggagggattgggatg

SEQ ID NO: 8256 - DNA, 700 bp, Nannochloropsis_gaditana
accctcagatagtggcgtgcaaatagaatgcctactcttaacatgtaactgtttttcgttgtccagctacaggtaacattttgttgagcgggacattgccagaaaattgctctaattccgaagtatatttaaatagtatagaagtgaaaggtttttgactctgtggtgtgcatgaagggacggacgacggctgtgaggtgtacatgtggggacagtagaagagaagtgcctgcaagagtcgggatcgtcatatccagacttgcggaacagcaccatagctatccttctgacttgcgtttcctaatcctcagtcagcatcaataggcacaaacacattgggagaatcgacatatgcaggtgttggggcaggagtatgccctccagcctgtcttctccctctgagtccttctttcaaccggacagattgctgtggaagaggaatgtgccatggccgatagtgatttcacatgtttgaatttcgaggaagtcataatcccttggcttgagtggttgaagcggacgggccgggcaagagctcccaaaacacggaacttatatagacagtacgtgacggaactaacattacaggtaggaaaacggagccttgcggccgacttttctcacacagaaacagggatcagcgtatttgattcaggaaatttaaaaacaatgttatgaaaatcggtcacaggttgccatg

SEQ ID NO: 8257 - DNA, 700 bp, Nannochloropsis_gaditana
  misc_feature (386)..(652): n is a, c, g, or t
ggaggagggagggagggaaggaaggagtgaggaagggagggaaaggaataccgcaggagcgtcacggaatgatgccccggtggcgggagcggagaaggcggggcgcaggtagttgaacgggaggggaggaaagcggagggcccgaggggtcaaagggaggaggaagaagagggaggggttgaggaagcaaagggtgagaagagacgtagcctgtccagagaaggccccaacctccctccccgcccacgtccctctcttcctatccttcttcctgtcttccctccctgcctccctccctttctccctccctacctacctacctacctaactttccccctcgacaggacgtactccttcctccacgccctctcccacctgttccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcggtgcgccctccttccctccctccctccctccctccctgctactt

SEQ ID NO: 8258 - DNA, 700 bp, Nannochloropsis_gaditana
  misc_feature (1)..(15): n is a, c, g, or t
  misc_feature (605)..(639): n is a, c, g, or t
nnnnnnnnnnnnnnncgtggcccttccctccctcgtttcactcctcgcagtggatctcatgtgccgatgaaccgtctatcgcataaggctcgatctttcttcctgaatggcgcggctcttccccctcccttccctctctttcctccttatgtacctcctgtccttctcaggtactttaccaagcgttccacgtccagctccttcctgtcagagcagcaacattcggaggtcgaccaagaaaatgggcacatcagcagcccggtggaggtactttgcctccctccctcccctcctcactcactccctccctcccttctttccttccatcttcccccccttcctcccacccttcctccctttctcccttcttttctctctcgcccccctcgagccctcctttatcccatcaacgggggcgtgtctttcccctctaggtcgggtacaaggcattgatcccagaaggagcccaatcctcgtccctcgtccaaccttgcaccctttcttcccgtcctccttttctccctccttcccaccctcgctccctccctccctccctctttctttactcccctcgcgtctccgcaccccttagccctgcgaggccnnnnnnnnnnnnnnnnnnnnnnnnnnnnnnnnnnnggggggggaggaagagaagggagtggtgctggagctacagcgggaatcgtgcgccctcatg

SEQ ID NO: 8259 - DNA, 700 bp, Nannochloropsis_gaditana
atcagtgtgtatgaggccgtgctgtggtataaaggatcagaataagaagatcgtcagccacaggacatcggacagcagtcactctcttgaatgcccgtaaaatgtgaagaatacaagcccaaaactccaaaaagctatccatgtaccaaacatccttacttaaacgtacatataaccgaacatgccatgtggatgcaggaaacaatgttttacatgactgtcaatcagtacgagtgtcgaagcccgccacgccttaacctcctcactccgcgagtctctgcttgcacgttcgcagacatgttgtctgagacgggcgtcatgcatttccttgtatggataattgccatgtgcataagcatacacctgtttcaaaaacatgacgaaggccttcgaccgaatgtgctccgcctttttcaatcgtgcatgcttaaatagtgcaagcgcagtctacggggtgataaattcgctctggaccgtttccgttgccacctcggattattccagatgatgttcgtaataaatgaaaatgttcagcgttatccatctcttctttttcaatggttgtttttgattatatacacagtaccgacaagaatggcaacggctgttccggagcccatggatgccctcgcagagtggcgggtctttcttcctcttcctacaaaactaacatcagcggtactcggagatgcctttgatg

SEQ ID NO: 8260 - DNA, 700 bp, Nannochloropsis_gaditana
aggaacgtcgatgcccgacggcgtttcatccgagttcctcctagcgctctatggtctggcagatttgaaaatatcgagtgagtgaatgcgcacttatcatgacaagaggcaaatttaaaggcttgaactgtcgagaagacaaaagtacatgaagagaagatcggcagtactgtgtgctagggtcatggcgtcaatttgaggcctggcaacgaacgtggctgtggggaagctggccgtttaatttcaaatttaaactgtcacccaagccatgggctgagcctccggtcaaataaggttcacattgcacgtgaccttcaagctgaccatgtttttctcgaggactttgatgctctgtggacaccgatttggaagaagagagaaggacaaacggggtgtttgatattttaagtgccgagggccttggcttttcagaagcgatcggccgggtcatcgccaatcactcccagttgcaggaggctacagacaagtaataggtttcgcttcttgtaaggtatcaattcccaagccgattcatactgtgtataactttcgatacaaaagatgtctcgtactgtatatttgacaaccatttcgctccgtgaaagaacgggcaacaagctcttactaccgcgtaaatgacaactactttctatccaagtgcacacatcacacgacagaattacagacaatgtgccagcga

SEQ ID NO: 8261 - DNA, 700 bp, Nannochloropsis_gaditana
ttgacatgcagtcacacgcatgcgactcatacctatgaatgtttgtataaattgtgatgctccgtgcatagacctaagtgtcttgcgaccggaaccctttatttcctcatttttccggcgacgggaactgttcctgtagtgtccttcctgcttctcatccagcattcctgcttgcacatgacaactccatcaacaggaaggtggcgcgtgcctccacgtgtcccgccacttcaggtacacatcctttcgccttcgcatggaatcaccggtagattgcgtgctaattgcggcttttgcccacacaaagacgagcggccttctgtgttgattatccctcttcacctcccctatcaaagacgtgaaaagattcgactatccacttagctggccccctgcttcctccaaaattctctagaaaccccgtgtaggcatgaatcagtcttcttaatgctgtttgaagacatgggtggaagagacatgaagtaaataggtacattggacatgaagttcaagcgcatctttttcatcaccccgtccatcatgctgcctcgctagcatacctcaacaacgtcttctgacccacaaccagcgtcctcactccaataatttgcattcacaccgatacttgtataacaggatgaggtcaaaatattcttatctgcccgtggcagtgcccattgcgggttggttactcgcaatg

SEQ ID NO: 8262 - DNA, 700 bp, Nannochloropsis_gaditana
agaaatgcgaaggtgaccctggatcttgccttcatagaagaaaagcatggcgaggcccatcgcgattgaaaagagtacttaattcttatcttaacaaatattctcattttttaatgtttccggctcactttatagcatgcccttagtgatgcactgtctttctttttcaaccttcacctcccccttatcctcgcacatttctaacagaaaatcgtcgtcggtatctccgattatggcgccacaaatcgcgcgcctgctccctccgctacaccctcgttcgcctcctcttcgtccaagaagaagaaaaagacccttctcgttcccgttggggacgggctgcatggcgggatggaggacgggatagagggcgaggtgtgggcctcccctttccaggaaaccatctacaccttctccccgagcaagccctccgagccctcccccacccacgaggcagcggaagtcgaagaagagatgacaaggtggactaatgggattgaggacagatgaatagtgcgatgcggatgatcggaggagagatattcccgagtatgcctcctggcgactcaaatgtgttcttctggggtcggatttgggagggaattgccgtcgttgctgatgtgtttgaattcgtgtatctatcccacattcttcttatactttatatctttgtttctggggtcacgaagtcatgataaagatg

SEQ ID NO: 8263 - DNA, 700 bp, Nannochloropsis_gaditana
ttgcgtgcatgaccttttgcagcataggatccaacctcccggcacgtccgaaaccccgccggcctggggcctccaccttttaacggctcgacttttttggcacggtctccctgctagggttagggttcgggttacctactgcacgccacggcgatcggcggcatgtttgcggatgtgtctcccgggcgtatgattatgtagatggtggattgcggtgtgtgggatactcgcgggtcggccgggggatgtgacagatgggctgcgacttccctattttgtaagccgtagctccctccccagctcggcactgctgcatcgcatggaaggtaccataaataaagttggtgcatgcctgcaaaagcgaagagtctacaccttttctcctcccttgcttgcgtcgtctctcgacagtgccgctcgcggcgtcggactcagtcgtaagggttctattttgctgactgggaaaggccctccatcccactgagaaacgatacaattccgtcattaccgtaccctcctcaaaacacctttccctccaaccctgttccaacccgtacatagcaaacaaagcctcgcttggtttctggaggcttgacaacgcacgcgggccgcccagagccgcttcagagatagttcaccggggttgagtccggacttaacctttcgaacgcaccaggcatccgcagggaaaaaaaagatg

SEQ ID NO: 8264 - DNA, 700 bp, Nannochloropsis_gaditana
cagaaacattcttgcccaacatgtcgagatgacttgtttgattacaaatagcttgtctcgagcaggggaagaggcccgcgcgagcaaagtcgtacgcaggcagtgctctggccctatgtcttttcctgatatgactcgctctccccacgtgcgtcatatatttgtctcccctggtggtgaaacttcccgtcattttcttaaacaccgcgtgacatgtacagttgcttcttgcatcatgaccaggctatacatggtcctgtattgggcaatgttatggaactcacgcgtgcatctcaacttttgcacaatccttgctttgacagggcgcaatttagtcggactgactcgacggttccaacccgctctcggtcaagccaagatcggcttcccgcatgcctctgcgatctctctcgtcgcttcttactcgtggtcgtgcaccgacagctaatctcactcgtcacactttgttggtcccggcatgcgtcgctcctcgttttccctggtgccatcctctcctccttcacctcgctcgtgctgccaccaccacgactatcccgtctgtgtctcatcccccccaggatgccgtcgtaccacaggaaccacgtcgttctcacaagattgatttcggaaacacaaaagtagcttacgcttccgtctcgacgggggagctggtgcgggcctatctggtgttcaaagcatg

SEQ ID NO: 8265 - DNA, 700 bp, Nannochloropsis_gaditana
  misc_feature (1)..(602): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcccttctttttgtctcttgcctggacgtcagcacaggcttgatggccaccaaggtccttgtcttccaacactctacctccctccctccctccct

SEQ ID NO: 8266 - DNA, 700 bp, Nannochloropsis_gaditana
cggagtaaggccgtcgataacttagatgagcggcgcatcgtttccgatttgtgtcctccattccattacacagggaataccctccccctcacctcgcatggcaccgggccaatgcccgtcctccccccttcaagttgtgcactgtcgctttcttcaggttccattctttgaaacgaacacgacatgtgacattcagttgctgctgaagtaggcacaattactctgtctattccagaatcacctcgcgtgcgcctaaacctgtattaaaatttatggacaagaaaattcttgtatcaggaggtggaaccagcagaggaagggagactgtaagctgaggaacacaagtgttccaacccgccacccttaaactcagagacgagcaaaaacctcaccacgaccgtggcgcaaacgactcatcacgattctagccaggcgtcgggaacagccagccgtcgtcgcgtccgcgggtatcgtgaagggatatatttcctgcttcttcgttttaagcgagtcgccgtaggaaaaatttggcaggaaaaaccggagaggcaatcaaatctgtggcacatttttctcaaactatggttgcgcgcctatgtccatccaatgacggactgcacattcacatgtacaggacatcgagatacagcgggcttccgagcacgcggacgggcagacccagcgcctggccctggaaatg

SEQ ID NO: 8267 - DNA, 700 bp, Nannochloropsis_gaditana
  misc_feature (97)..(536): n is a, c, g, or t
ctgtcctcctcttctccctcctctgcggcctcccccgcgccttcccccgccaggcgccggaagaatgcctccacagccgccgcttcggccggtcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggagggaggatgggaggaatgtgatggccgtatcctctgtgtattgtctgtgtcctgacgtacgaggggctgactacattcctggccgccctgtcctctttccctccctccccttccccgccccccgttattcgcagcccgcccgggacgggtaagactatg

SEQ ID NO: 8268 - DNA, 700 bp, Nannochloropsis_gaditana
  misc_feature (1)..(135): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatgaactcatctgctgatttgtgagatattggtccgggtcaccggtcgcgcatctttgttcaatattgtcagaagcgtggctgtcgtccttcgtccagcagttgcggtgttttatgcgggcacaggtaccagagataagacgagcaggcgaggcgatgacagggaccgggcccctgcaatgccccgcaaaaaggctcgttaaaattcgctgccgccttccacatccatacagcatccactggtaccactgtaagatgcttgggtaggctttaacggcccttttaaaaaaaaagcaatgcatcatgggagttgtgtgagttgatataatgatacttttccccacagtgaacgagagggcagcgagctctcccaatttaatgtcctgaaaatatcgcgctcccttccgcatacattaaaatcataaagctgtccgtctttcgcgtccctgccttatgttttcttcgtgtccacgtcttaaaaagctcaaagtcgagggaaaaagcaaggggaagatcgctcgcttcctctcgcccacgcagacccggcgacaagtgcaagcatg

SEQ ID NO: 8269 - DNA, 700 bp, Nannochloropsis_gaditana
gcgtgggcggagtacttggtccgtacttccccaagtgaaagagcctcccatgccgccttctttaccggcaccggtatcaaaattctgcctgcgcgtcgatgttcctggcatgacgtatagaaaaaggaagcgacggtgtcatgttgtgcactgtggccgtgtattcctagtctttggggtctggatccgtacctgcgactgcgaatatcatcgccactatcgcggatgccgggcaagcgtgcacgcagtcctatggcaccaaaacgaggcgtgccagatgttcggcacgggtctgtcatccggaagtcacgtcctcacgataatttaattgaaccatttttgatcgagtggtcgttgccgatagaggtgttgtttgtgtttggtgttcttctctgacagccgctggctcaaccatgtgtcgaggcgctgccgtacacacgacaacgacaaaaaattggtttccgcctcacgcctctgcctctcagggaacaagatgtcgatgactgggagcaagtgttattttcaggtcgcatgtacttgtcattccgggcagcaccgaccctggtgttgaacatgctgtgtcgaaattgccagcaaggcaaaactctttcctcacgagtcctctctctctcccacctgttttgccttccggctgtgcccttttacagtcgcatccatcggtaaagccaaccacgccatg

SEQ ID NO: 8270 - DNA, 700 bp, Nannochloropsis_gaditana
gtggtgttggtgtggaagacacggtcgttggggcatgggccccatttgcacgagtgcttcgggcaacaaagggaggagaccgctcgtttcgtgactgagccgaggacgaggacgtcatccaaaaatggcagcagggcctgtcggggggtacaaaagaatatgaatgaaagccgaatgatgagtgggcaatgcacaaattgtcggtgacgggtgtaaattaagtgtgtttttaaaagttcgccgtcccgtcattcaactaaacttgagttcagcgacaggaacggggccgatatgggggaggaaatgctactcaaccctaatgaaaaatgagaagcttttgtgaaaacaccgacgacacatacttctcaaagcagaatacagaatgtacaaagcgccacggtggcagaaagtggcgtgtctggcgaggggggggggagtcaagtcgaagctgtgcaatccgacttgacgttggcctagtgcatttttttttgcagggaacaaacgcattgaagcctcaagcctgccactggggatgggagacgatgtgtgatggacaggtcacaatatgaggatgaaggggaggatcaacaattcaagctgccctcctccgcacatttcggaagcgagcatgggaatatgaagacacgacccaacttgcacgctatcgaaacagagtggcgcgccgaccaagagcggcgcc

SEQ ID NO: 8271 - DNA, 700 bp, Nannochloropsis_gaditana
cacgccatgaggacagtgagccgagtcacaagaaaactacatgatcgctgcattggcaacatttgcaatattcctcatcctagcatcgcacatccgaagcggacgcgttacacggttttcttcttcgatcgtcgccagctgagggccacacagccctcgacggaaaagagaagcgagggccgcaagataccatcatgcccggctcccccccacgcgaaaattgtctttacttccccactatgacaccacgaggggaaaacaaaaaaacacactcaaggtgttgtgcgcatctgaagctgcctcgccagcttagtcaggaagatgcatgcgcagacggggtcgcaaacgcaggcacaagcttggaaagggagccgtgttggggggaggctcgcataaaatttgaaattttagggaagaaagtcgggttaaagcgggggaacgtttttcctcaacaggcagctacctctttccgacgtctttcaggacatgcagcgggagggaaggtgtggagggttggaggagtgtgtaatccggttttacaaagcgtccgggcaatttttactttttcacatgaagaggtagtgaccgtcatttttcacctctctcattcatcatcccgcttttgcccttttgctctcgatcgacgaacaggagatggaggacctggcggttgggacaaccgtagaatcattagagccag

SEQ ID NO: 8272 - DNA, 700 bp, Nannochloropsis_gaditana
cggtggggccggtgaaaacgaagcaaattggtccagaacagagctgacggagaagctgcgttaggctttattgtcatgagggttaggtagatcaaaaagctggcatgagcaatacaggctttatttttcctctcatagagacattccaatagtggtgcacatgttgcatccactgcaccgtggtgtgcacattttcgtgggacctctgtgctcctacttgttctttaccacccccatcaccgttgcgagaggattcgggtaggtttttcttgcatggtctttttttccctgcaacggtcccaaaaggcatgtcacaccttcaatatatacatattaagcgcatgagggcctcaacttcttcgcattttttgcttcttggtttgtcctgggctggcatcgaagtacaacgtgcttaatggcaataggaacacgactggtccaagccggcatgcgtcatcacaatttatcccgcagagagcccaaaacaatacagtgaacgcgaattttcgcgtcctttgccatgtacctgcatgtacatgtaaatatcagtacctagaacactcaacgaatcagggagatgattgctttttcttcattttcgatacctgatttcgttctggcactgctccaaaccactacgctccttcgtactcatcgaccacgaacgcctccaaactatgcacaaaaaaggttgacgatg

SEQ ID NO: 8273 - DNA, 700 bp, Nannochloropsis_gaditana
tatctattcgccgcgttaacgcggcacggtgcacaacgtgaagaggtcagatctaatttttttcttcaaatcagctagcatttatacagtagtgaattaaaatgtcttcgacaatacttccttgcctatcgcatcaggcagggcatacgcgccaggcgcaggaaatgagatgatattttgggcaattgatccaatcttattctaatttagaattcgttctacgttattaaaatggcaaaaaaagtgtagagagcaattgaaaagaacgcccggggccatttcaagcaagaaaaacgcagcaaacacatcaagggaggcgggagcgggtccttgcagcgaggaagtgaagggaggcggcgacaggagggccgcaaaccgaggtggacgaaatgccaagtttatggcgtccgtgtgcaacaattcacgagcccgtcatcgttggcgtgagatttgcgtggctcgtgtgcttgtggctggcgcatcggcaggcatctgtgcaaatcatgcttgatttgtttgattgcacggtcgacgacctccttcctcccctcatcacaatcaccctcctcacattgtccttgccagctattcagcactcggacgccactgatttctattccaccactcttacttctagattgccacgaaattacgtacaaggactgggtggggtatagcctttgagccaggtgatacgatg

SEQ ID NO: 8274 - DNA, 700 bp, Nannochloropsis_gaditana
gctttgctagcacgctctgaaggtgaatgggcaaaaagaatatttgtgtgacacttacctttccggtagtggcgccccatgctctaaattatctttcagataccctggaccaatcattctgtggttttatgagccgagacattgaattgagcaaggaaaacaagggaggaaggaagcgtgtcatttcttggcgggaagcaggttgataccgcaagccgcatcagcgccagcaagatagttgaatggagggagatatatcttcccccggcatcgtcttcctccgcatattcgtggtcatagattcggcatggagcgtccgcgagcgcccatgcttgtgtgtgtaatcgtggacggcgtagagcccgcatgatcatcacggagagccgttgaggcaccgaagcgcagtacgcgcgctggctacaattcttgaggagtctgtgtggcttttccccttcacggggaagcgagggcgagaggtggctttgcacgaccacatcgcttgggggccaagatgtatgaaggggattgtttgtcccttttttggcggttgtgtgtgttgtggacggaagattgcgtctgggacatgatcctttttcctgaccttgcctcctcccaatgctgccatttattcacaggaggaggggttgatacaccgggagggcagcaagtctgtctgcacctgccactcgtgtacaggatg

SEQ ID NO: 8275 - DNA, 700 bp, Nannochloropsis_gaditana
  misc_feature (1)..(482): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggaaggaggccttcttgcttgtctgccgttcacttcacaggctagtagaagaagcggagcaagcggaaagacgaaggggctgaggcgggaagtgccgtttacgactcgaacgaggcgaactacagctacgacgaattgttggaacggatgcaaacgttgctgcaagacggcgacccgaccaaatctgtcacgtccgggcgcgtgcccatcaaaatg

SEQ ID NO: 8276 - DNA, 700 bp, Nannochloropsis_gaditana
  misc_feature (1)..(536): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaggactttccccaccttgttatcaacagagactcaccggcacacgcgcgaaacattgtggaaaagagccggggcttggaaggtaatacggaggaagcgagcacgacggacgcagagccgtccccggcacaacaatttgtgtctttgcagcgggagaatatg

SEQ ID NO: 8277 - DNA, 700 bp, Nannochloropsis_gaditana
cgcttggactgatgcttgttcgaccctgaattttgtgcttggcacgggcggtcagcggtgtataaacgggtacctgaatgtcgcatttggatcaggcctatgccgggctcgctgaaaggcgaagaaggaaactgtccgtcattcgtcatccccattccagcatcggaagacgcgtctctgtgccaagagcgttcacgttgcgtttttcgtcctggaccccactcattttagccctcccgccctcccttcctctttcccaaacatccccccatccacccagacaaagacacttggtggccttcaactttcaaactccacaacagccccagccgccgtggtcgcagaggatgcagggatgcgattcgcacgcctcagggggaggggatgtatgtacagcgaggagattgaagagggcgtccggcgttccgtctgtcgtgcaagaccagcctcgtatcctcgtccggcacggggcgtggggctcatcactgtcatcgcatgcatctctttcttttccttggggggcttggtcggagtgacggggcccgccattccaagcctcaccgtccacctggggtgccgcgacgaaactcaacttggtagcgccttcacatgtcgcggagccggctatttgacgggggccgtgctggcgtcggtgctcgacacccgatgttcgaagggaaaacacctggtggtggtgatg

SEQ ID NO: 8278 - DNA, 700 bp, Nannochloropsis_gaditana
ggcgggtcgtaaagagctccaggtcggcatttcccggagaattttcctcgtcgtgggccaaccgacgcagccctaaagaggaggcgcttaagtcaatgcctcccttcacatttaaccagtgtcgaaaggcgtcaagtgccgcgtcatcgcgagaaagttggaaggatgcgggggccgatggcgtggcagatgcacagagggatcgaggaagaagggagggatgacgaggacgagcatggtggcatgtcgcgaggtttgggtgattcgaaagggcccttgcgacaagatcatggctcgtgggaacaattatgatacagagcagaaagaggaagtcccattgccctgcccaacttcgcattcaggcgtccaaggtcgtagtatatgctgtgaaagcagagagcgctttgccggaattgtcactttccttttccagtgcagcttgcttgcccttcccctgtttgacaaaatcacagatcagctcgtgcagacattttacagtctatggcataatataaggacattaaatcataaatgacatgaaacatgggcatacagagcctctttgactttcctctagctctctgcttgtcttggcgagctctggcgacaccacgggaccagaataatactaatgcccgtgtcactttccattaagacaaccttttttaatcattgtctgattacacacacactaggcatg

SEQ ID NO: 8279 - DNA, 700 bp, Nannochloropsis_gaditana
cgggacaaaggttggaagtcggaagattgagttaaggtgaggtgacgtgtgaaaaaaggtttaaatgctggtcatgattctggaaggacagggaggtttaatatgatagggaagatcaaccatgaaggacttacttatccgacccccgttccaaaagcaggtttttgatgtaataaatgagcttcggatcccgagccattgctatttttataatgaaaatttgttcgtcatttagtattttttgaatgagagcttagaaaacagttggttagggtccagagcattgcgaggccacggtatcctcgaccccataagccacaagagatagggccttccgggcccgttatggtgacttatgatctttgtcacatttattcatatatatttcgtaaaaaaacataatgtacatgcgtgggaggcgcggaagcttgagacgggcaggattaaaaagtccgtgtgggccgttcattggcaatgaaacggaaggcgagacccgcggtactgctcccacgaatggaatgcgaatgaatgactctgacattgacgccaacaccctgtctcatacagaccttccttctgttttgacgacaaaataagctgcatgttgtgtcacataatataaagtcaagataaaggtgtgtgtaatgtcaacagcacaatcaacctccccaccccaccccatacacaggagcgacgatac

SEQ ID NO: 8280 - DNA, 700 bp, Nannochloropsis_gaditana
  misc_feature (1)..(137): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggggatcagtgtccatggcaggtaaagcatacgcgtccgtcaatgtagtaaggcccgaggcattaggagggtaaggccgagtcaggggctccgaaggtatcgtgtcatatccttccttgtcgctgccctcccggacctccccctcctttcccttggtcttgcctcctcccgtgtccgccacgatgctgcggaaaatccggttgatggcaagcaccgccgcttccttcgtcaagctggctagatcggccccgacatatcccggtgtcctccgcgcaatttctcccaaatcaaagtccccgctcagccgcattttcttagtcatcacctccaaaatcctccgtcgggcctctaaatctggcactccgagggaaatctcccggtcgaaccggcccgcccgccgcaaagccgcgtcgagggcatccgggcggttcgtggcgccaatgaccaagacgggtttgccccccgtctcctccagggaaagggcatccatgcacgtcaaaagctgggccacaatccgacgttccatgccccgggacgccgtctccctcttgggggtgatcg

SEQ ID NO: 8281 - DNA, 700 bp, Nannochloropsis_gaditana
  misc_feature (338)..(495): n is a, c, g, or t
catcgggcacctctaccgcacgttggagaaggaagcctgccaggtgctggagatgggtgcacgcgtccacaagcagggcggccgctgtggagggaggcagggaggtggcgggaaggagggagggagggaaggagggagggaaggaggaagagggggtggaggcaggcgtggcgtggaagcacaaacgatggatggcctccgggatggcaggctgttccccgtgcatgtcgtccgcaatcaggtggccccaggcttggaccagcacccgtgcctcctccaacaaggccaccacgccggcaggactgcggtcgaggctctctccctccctccctcccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggggatcagtgtccatggcaggtaaagcatacgcgtccgtcaatgtagtaaggcccgaggcattaggagggtaaggccgagtcaggggctccgaaggtatcgtgtcatatccttccttgtcgctgccctcccggacctccccctcctttcccttggtcttgcctcctcccgtgtccgccacgatgctgcggaaaatccggttg

SEQ ID NO: 8282 - DNA, 700 bp, Nannochloropsis_gaditana
aagcaggtttaatggtggggtttattgtacagcgggacctatgttgaagacgtcatggacgctctccctccataagctgaagaactctaggaaggcatttaggggagatagatacgacagaggtgctcatgaggtatttcactgaagcaaagatgtgaatgccaatattttcattcagtaagatgtgaattttcgatgaaaatcgtcggtactcgacgcacttcaatttttcaatgcacggatccccttactcggggctgaacgtttcaattccacactttatgtgagctagatgtaatgatgtcaagatttgagcaaccggacattgtatcttatttttatgcttctaatttgaagcacgcaacatgatctccgtagcccaggtaaacccatctttacaacctctggcggactgtatgcacgtgtcgtgttaaaaaaatcaaaattcaacggtccagggaacccaagatttaaaaaattgcgcgaaaagggagccaagatgatgcggggatataaagtcttatgtgcttttcgatggtttgcaaaaaatcgccgtcgcaggccagaattatgttcggctgatggacgtatttaattacttttatctgcccttggtaccgacagaatcccggagcgtcgtgataacagcggagttgagggtgggatgaagcgctttactcggagacgaacctctgacatg

SEQ ID NO: 8283 - DNA, 336 bp, Nannochloropsis_gaditana
cgccttcccccccgccctccacctcgtcctccaccaaccgagggggctcgttcttcgggatcaaaaacaaggcccgcacagggtgcaccttcgcgtacggcggtgcgcccttcgccaattcgatagcggtgatacccatgctccaaatgtccgcagtgatgtcgtaagaagactgcgtgatcacctctggcgccatccaaaagggggttccggcaaagctgtgtcgtttccccgccgtgtgtgtcagctgggccgtggccccaaaatccgcgagtttgatgtcccccgtggcagagaccaagagattcttggccttcacgtcccgatgaatctttt

SEQ ID NO: 8284 - DNA, 700 bp, Nannochloropsis_gaditana
gcgttggtggagtgctcgaggacatgcctggctacacccaaagcctccggattactgcgtagagcaaggagaatttccgaggctctcatcggatccgtctgcaacagctcacaggcatgctcgatgtgtgcgagtgcagcttccataggaaggttggtgtcggtggtcacacaataacttcctgtgcagggcagaggttagagccgctctctgagcggcgctcgtgctgcaaggaaaacaacagcgacgatcaagcccgttaaacactcctgcgcgcgcaagagaaaggtttatgtaaggaaaagaaaacatgagaatttatgtccgccaacgatgataattcgctcggttgagtggggccattggtaattatttgcgatgtgtgggggtggtagcttggcttcagcgacgacgaacaaatactcgaggtagaaatattattatattgaggtctttgcaagtaaaccaacgcatgcatgtttgaagtccttccttccttacaacataatgatggcataaatattcagtgacgagggcatatcatttgaaggacacgttcttgatggacgggtatggcagctggtgttgactatcatgctcttacccttttctgatgcaacgtataaaatggtgccttcacatggcgacagaaaaaggtgcaagccagtgaaattaaatcacgaggaacaaaatcgtgatg

SEQ ID NO: 8285 - DNA, 685 bp, Nannochloropsis_gaditana
ggcttaccctcaaaactccaccacccccgccaccaccaccgccccgtgggggaggagaaaaattgctggccgggccgtaatatgacatgccgcacagtgagtctagtaaacctgtatgtatgcatgtagaacggacatgaacgtgaaaaaacgagggaaaacggataacgtgacgatccgcttgacaagggaaggaagaacaccggtatggccggagacatacgtaagcatactcctccgtctttacttccgacacatgtccagctatcgcgtttatgggcacatctatagagctgtgtaatttctagctgataaaatgtaggtagagtaaacatcatgctgtagtgaaggtggcgtgggaccaagttatccaaggtttacaggtataacgcggcctctcgattaacctcctctgccgtgcttgcttgtcacttctgcttttgaaaaggaaacagaaaagacttcgatgctccccgtgtgtagtcttcgcctgtcatactctcaaaaattcctttttttcgttgtcgttccaccatttgtgccttcagtcacaggcataaggcggttgacggcgccctgctacatgcagcatatcatcctcgtactttttttctgttttgtcagcttcgggcatccgttcagtcacaatcttatttcaacaggtcactcagatctatctgacatg

SEQ ID NO: 8286 - DNA, 700 bp, Nannochloropsis_gaditana
  misc_feature (668)..(677): n is a, c, g, or t
accacctcgtgtgaccctttacaggctgtcgacgctccatgcgtcaggaatgtgcgttacaagattgccgatttaccaatttaattcgtctcatccgatctcggggaccctgcgagagacgcgacgagcagctactctcgcttctgcctaacccttttgcagccctttttccccccgggaagcttgtgaaatggacgcgaatgatgcaactttagcagccaactgcgcagggttgggtgtacctgcgacttatgtgacgcaagggttggaagcaggtgttcggaaacgccacggctattttcggcggctggtctctcaccggcgcttgccacctgacggctgggatgatgccaccatcgaaggcgtcctgcacgatctcgccatgatggacagcaacaattttctgggtaacgttggtgttggtgagagggaggcacgcgtctattcttccttggtgcgacgacgacattacgggctcggccatgggatggggcggtcgggagatatcatggagccgcaaccgaaagcggcgggctcctccctcctcgtgaagctcaccaacctgctcgcgttggacgcagtgcgggcagcagggttgacgcgcatgcaggattgtgtggtgctgcctttggccacggggatggccgtgaccgtgacgcttttaaccnnnnnnnnnngaggaggggaggtggaaggaatg

SEQ ID NO: 8287 - DNA, 700 bp, Nannochloropsis_gaditana
cttcttgactttacgggtcgcgtcaccccgtctaatgcctgacagactgtcatccgttcttgtgttgctgcctttcatcgtttccctgatgacagaaaccaagctcgtgcaaatcaacctggttagacacaaggataccaggtcagatgagaattgctgtcagtagatgcgaacatcaatcggaagaagctggggtgttgttgcagtgcaccgaggaagtgggataggagagcatatggcaatacccccgcccgtcgtcacactcattgcttatacactactaccacgcctagtcaagttctccttatatgtccagacgttaggacgggcattcgtccccaaacaaggcagtcttggtgtcagaacacggagaccacgggcgccatgagacacctctctccggttttgattgcttgcgcgtgcttgggcgagttgcacatggacatgcggtgatcaaagcctcgcttaatgcaagtcaagacatggcgagggcacttcaccatcagcaccacctcgtgtgaccctttacaggctgtcgacgctccatgcgtcaggaatgtgcgttacaagattgccgatttaccaatttaattcgtctcatccgatctcggggaccctgcgagagacgcgacgagcagctactctcgcttctgcctaacccttttgcagccctttttccccccgggaagcttgtgaaatg

SEQ ID NO: 8288 - DNA, 42 bp, Nannochloropsis_gaditana
gtggtggcgcctgcacccgtggggggagggagggagggaatg

SEQ ID NO: 8289 - DNA, 700 bp, Nannochloropsis_gaditana
  misc_feature (319)..(645): n is a, c, g, or t
tgcgaataaatgaaggcaggctagagaggaggaagcgagggttcgggagagtgacgccagtgatggacggcgtgcctgtggtcgacggccttgaaatgggccgtgccctggcttcgacaacatgcgtctccacggctttggtgtcatccgcatcgactcggtggcgtatgcctctcctttattttcatccttttcccccgggcgtcatagagtacaatttatcaccgcaatgcccccacatccccgcctctcaagcactttgggggcctcgacatccttcactcctcgcgccctcggagccgcggccggccgccttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtacgcataaccgcccaaatacaaatctgtcgacagcttgacgcagccatcatg

SEQ ID NO: 8290 - DNA, 700 bp, Nannochloropsis_gaditana
gaagcagacacggtcgttcgcatggttccgtttccccaaaaaaatgctgatagtacgaaaaatgttgcaaggtgagcagtcgcccgggtctatcatgtggtgcgctgtgccagacgcttgacaggaaatgtgaacacgtcatgggccaggcaagatcgggtcgacgggcacgcactccgagcgagagtgccacatggagagcaaaacaagcaccaccataccacaaattaacaaatatcacacatcaggcatgctcctattagaatacccttcagatatatagggcaccagcgaccatacatgccgggaatgtgaggaaaaaggaaagtggtgtgccgcgtccctgccctccttttttcctgctcggcttggaaggaaatattcgattggcgacatcgcgtaaaattcactccttaaaggacaccattactggaagtcttttcgatcacgatgaagtcacaggcgtgcgtcacgtgcctgggggtacgaacttgttttttttcccgttggtcgcatggttgttcgatgtaaaaaggggacaaactttcttttgagtcgtggtactggcaataaggtactggtaataaggatgacaccatcgcatatgtacagcccgacatatgaagtcacggagaccctccgtggggtcaaaactcatcacctgacaaaccacacaacacattccatcacacacatcata

SEQ ID NO: 8291 - DNA, 700 bp, Nannochloropsis_gaditana
  misc_feature (257)..(266): n is a, c, g, or t
caaatacctcctaccccgtctccgcccgtgccgtcttcaagcattcctcagcttttttctcagcggaaggaagagcaggtggaggagcgacagacagtgctacagccgctccaacaagagccaccaccacagccacaaccaggacaagagcaacaagcacagccaccatcgcaacaactaccgcctgagcaaacgcccctgccgccacaaggagaggaaggaagtcccctcaaagaaagagaggagggtgacgaccnnnnnnnnnnggcgggcgaacttgaagccagctgtcgcctcggccctgtcctcgtgcctgcacgcgttccacgcccatgggcccatgattgctctggacgagattctctggggggaggtgattggccacggggcctttgccactgtctatcgggccacggtccaggggcaggacgtggcggtgaaaaaattggtcactcagaacaatctgcccatggcggagaagagcctcagggacttcgaatcggaagtggcattgttgcgagaattgcatcatcccaatatcattgcctttgtcggtacctgtgtagatccggtggcagttttgacggaattctgtcaccgaggaaatctgtttatggtagtgaatgagaaagggccgccctacacggagatagcttggagccgacgactgtcgattgcgaagggattggccgcagggatg

SEQ ID NO: 8292 - DNA, 700 bp, Nannochloropsis_gaditana
  misc_feature (1)..(522): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggagggagggagggagggagggagggagagagggattgctttgaagaccgagtaggccaaatttgcatcccgctcctgattcaccttccctttcttccttccttccttccttcctccctccctccctccctccttccttccctcagctcctccgcgctatcctcaacacctccatg

SEQ ID NO: 8293 - DNA, 700 bp, Nannochloropsis_gaditana
agtcacccgatttttagcaacgacatacattgctttgtttacgctgcttggtgtcgtgaccttcggcgggagaaggttgagacaactcttcgcacccaacgggacagcgaaaaccatgggccgttccatgatgcaagaggaacactcttattgtcattcgatccttcccttccagatcctttgcctttgcatgaggccccattcgcgcacaaagtctcagagcctcgattacacccacggttcattatcacctcgggaaatgcatagattgcgacttcagcgctgactaaaggaatcctatcgggcacatcatccgatgggctccttcctcatgggcaagtctagagacagaaatgcagagggcatgattcagacagggaatggcgagatgcaacaggctcacggaggacgtgcccacggcgtgaccaccgagagaggtaccccagtctctacatgcgagaaagaggcctcgcaattgatccagtcgaacgcaaccgaaatctgttgtgggaagattaataagcggggatacgagggcttcaactaggagtgcaaggagagtcgtagggctggccgacggcggggtggcgccacagatcagagccccagggtgctccagtccgttcccttccacgttgagctcccttggaaagaggacatctgcgaagagccacatccaagcacaggcaccattcctccc

SEQ ID NO: 8294 - DNA, 700 bp, Nannochloropsis_gaditana
gttaccttcacaactacccccgtattctacaagtgctgcttctgcgcctgctagccttgagttggactacatccacacttcgacacataatgcatcgttgcccagccaagcgacggctttgggctcgctggaccgtgttgccttttgagatgccattgcgtcctcctttttcgggcagcccagacttctcgtgacacgtgaagtgcaccacttgggaagaaggtttcacccggtgtgtttttcagtcgttgccattgctaccgcgccattacatttttgcacactgtggtgctaacaggcggtcggtctgaaagaaggatacaccccctgccctgagtaggctgcgtgccctcatttggctactttttgcacgcgctgtacagctgcatttgccgtactgcattgcacaacagatagtatgagggtcacaatgcggtattctgttttcagtggacacgggcggcgtcggcctgtagcatggagacgttttatgtgaaagagcagctagcctcccctcgtttagttgaccacgttgacaatattttactctcacatttttcattcaaaagcggtaaattcgtcaagtatgcgtcattgtgatatagaaaaatgatcgtgatcaatgacggcgtatgtaagcatagttttggtgctcatccactccctcgtgtcctctcgtttcacatgacatgccagcatg

SEQ ID NO: 8295 - DNA, 700 bp, Nannochloropsis_gaditana
atttggacagaatgtgcagaagaaaaaagaagcagcacccgcccctgtgccagagggaagtggggggaaggaagaagaaagaagaggagtgacacgagaagaattggccacgccggccgcagccggggagttcaaggctaagatggatgaagtaggcaagagccttcaggcgctggccgaccaagtgaacgcacgagagggggaaggggaggtaagaattgcctggctgatggcaggaggagccgtgaagtgcgcaagagtcaaagcttgaaaccctgggtggcgtgatccattgaactggcacaatggtcgttagtaagcgcaatagcacctagtctggtgtggttcactctgtctccctccttccttgtctctgtctctaccgtcctcctcagaacccctacgaccctgcctttgtggcggaacaaaaacgtttgcgtgctgagatagacttcgagcgcccgtacgcccgggttcgccctagaaactgggattacataaccggattgcccgtgcccaaaattgtccagatcgaggacgtgagtgggaaacggaagggagggagggacggagggcgggggggagaagaggcttcgaatccgagatcaagaaagcaatattcttccctcccctcccttctccatccctcccgccctcctttcctcccatcatttagtcataccctcggtctagacaaatg

SEQ ID NO: 8296 - DNA, 700 bp, Nannochloropsis_gaditana
atgctgtagttgtgcccccattcgacgttttgcaggggaaagacgagggaaggggaaaaaacagacaccgcctcgatcgcagccggacctcaacaacacgacacagatcatgcaccgaataattccttccccgcagacagcatccgtgtccgttcttgcaatagaaacatacgcctctgctcaacgttgccacaccccggccgtaaggcctgcgtgccggtgcgggtgaaaagtggcttcagggaagaatctatctcaccaagagggcaaggagaagccgtctttaacgtttaggggtgacaaaaaatacacgtgtcctcccactcttttcaaccaccgccgctcgcacaagcatcttgactagctcgtcacgggaaccagccatccccctatttttcttctccccctacacggtacaagctgcctcatttaatttctccgcttggggaaggcgagagcgtcgctgtgatctcgctcgccctcccacccgctgagcacttcatgccacatgtatgtagacacacattgaaacccacgccctgtaaccccccgatccttttaatgtcaacagtgcgcgttgttatcatgtatcttgctatcccttttagggccgaagttgtccgtgttcaggcctcttccttctaagccctacgcggcaccgcctccccccctctcaacagcaacacctgtagtatccatg

SEQ ID NO: 8297 - DNA, 700 bp, Nannochloropsis_gaditana
tgaaagattacgtgagatcgatgacacgttatcatgctggatggcttcgtcgggcatcaaaagggtacaaattgacatttactggacatgttgctgctatcgctggactctgcgggcgaggcggtgtcgataggcagctacgacaatgttccccatccgaaagcgtgtcatcccacagtacaccttctgtggctactggggaacgagattatatatcgcgcgtgcccagactgtcatcctatggtacttggatgccatatttttgaggctgctattcttctaagcgcagcgtgggagggagaaggagagaggaggttgactcgtgtcagctcgagtcacagcatttcacgcggagcaagcgggaactatcttgaagtcaaggctattcaccacacaaacacgtccacttcaggaggctgggtacggcatcgaccggcttcataaggcttgccatcgcatgctcagatcgtggggtgccctagcgtcgatcttcaaccccgcaaggcagtatctcggccttccactcacattcattgctaccaacacctttgtctcccttgctgcaacgagaaaagcattcataaccctccaagacattcaagtctgggagtccttggtccctccgcgcgagcggccgtcgggctcaacttgtttctcacgtttcccccacccttcctctacccatttgcggtcctttatg

SEQ ID NO: 8298 - DNA, 700 bp, Nannochloropsis_gaditana
ctgctactacgagtacaagagagccgcacggtcattgacgctcgatcgaaggcatgatttgtgggtaattcaaggtaatgggagatgcctccgtccatcacagctggtatgggggcaggttagagtgaacctaagaagggacggcccatggggaggatctcatttgttcccaaaagcggtaccctcgagcgcatctgtgggatatgattgctgtatgtacccacttaatggaatgggctatgagaagtatgatacagggaaaagccattgacaattgataacattttaaaacaaataaaggtcatcaaccattgacctctcttacgacagaaacatcgcggggagtggatgtgtgttggtgatatgtcaatataaaaatatttaaaaccagtacacttgtgcacgcgcaactccgtactactttcgtagtttctggattcatttcctgtcatgaatttgagcccttaatgcgacacggaggccaacttaataagacggagtgggaagcacgatgaaagaagaggagagagcgaggatgcaacgtgcgcgtattcgacttttcggaagctagagcttcgccatccagacaacagacgagggttgagtgtccacatcttccacgcgcattcatgctcagcaggctgtgttagtcatgaagccatctcttttcctcttgtctttcttcttaaacctcctgatg

SEQ ID NO: 8299 - DNA, 700 bp, Nannochloropsis_gaditana
gatagagcaatcagcgcttccggggggctatcacgaatatagatctcctaactcggaaagctccgattctgcttcgcaaggcagaccacggtcccctcactaaggacagcccggcctctcaagaaatataatagaccgctgtatgttctacaggtgtgatgcggccggcttctgtacgatattgtgtccataacgctcgctttgctgtcgtcgtggacggtgacgtgatggcgctttgacgtgggggtgttcatgcgcctatccaattgccgatcttagagactgccaaaacgacagaagtactcgcaacacttctcaatgtacatggctggaaagtgcatggcgaagtcttctgtctaagcttgtcatggtcttccaaaacagtcgacaaagcagctctttatttgctgctatggtgcgtcaaggttgatgttgagctccggccctgcatggtcgtcgatcctatatttcaaaacccattacaagggaaaaagaagccagactgtgaaccccaaatatttccacacaggcgatccttggcatcttaaaggaccgcggtctgtgacgatcgttcgccttggcctctttggttcgacttttccgtcctctttctcttcctcctgcttcttgaccctcttcatagaaacctctacctctctccttcgcctataaggccattggagcagccataaccacgatg

SEQ ID NO: 8300 - DNA, 700 bp, Nannochloropsis_gaditana; identical to SEQ ID NO: 6531

SEQ ID NO: 8301 - DNA, 700 bp, Nannochloropsis_gaditana
gacatgaccctgttcggtaacgacagaggtgtgaaatgctaccgctaaagaatatcatgcatcgcgacaggacattagagaaccagagcatagccagcctatatgctgacattgaacgaaatggtaagcaacacaaaggagtcaagattcctagctaccgtcttcctcagacgacttaacatgaaaagatttaggggaaaaaatatcacccttcaacataacctgttcacctgcctcaacgtccgacgtcttcaataaatatgcctcgtcacaatgaatgcacatgctctgatttaacatcattgctccaaatgtgaagttcctcccgccgcaccgaaaaaggaaaaataatacataataagaaaaggggaaaaaaaaagtaacggttttggaaaaagcgaagcccaacgagcctctcccagcctccctccccggaagtcaacctctcaggcacgttcaaggcgaatgccagtcccacgcgcgcctttcatgcgccctctacacggtgtgggctattccttaataatcctcctctgactttctctatcaggatattgctgggacaggggtattaattcatcagacggacgcccccccacccaagccgtcatatcctcctcgaggcgcctctctgagctcgcttcttctttctccttcgcttgcttcctagaggagcccattgtgaccattgggagtcatg

SEQ ID NO: 8302 - DNA, 445 bp, Nannochloropsis_gaditana
  misc_feature (369)..(378): n is a, c, g, or t
ggccgcgtgagactcggttgcctccctgttggctccctttcccttgctcgtctccgccctcccgccgctgctttggccttctgcactcttttggcacatgagtgcgggaggcatgccacgcgcgtggacgctcgtcggtggcgtgcgcggagaacctgctgatgaaacccattactcagctcactctgagtcccccggtcccccaaaatggagggtccgcggtcctgaagagagagttatccttcactttgacctgaaggtccttcgcacgcgcccccccccgcccgactggacgatcgggtcccacctttctcctcctagacaccccgcgtcgacgaccctgcaacgcgtcctcgccgtcttggttcnnnnnnnnnnccttcccccccccccttcccccccctgtggacaggtgaaattcaacccgggccgctccgacaacatg

SEQ ID NO: 8303 - DNA, 700 bp, Nannochloropsis_gaditana; identical to SEQ ID NO: 4446

SEQ ID NO: 8304 - DNA, 700 bp, Nannochloropsis_gaditana
  misc_feature (1)..(35): n is a, c, g, or t
nnnnnnnnnnnnnnnnnnnnnnnnnnnnnnnnnnngggggggggggcatcgtgtggggtttctcttccaaatctaatatcatttctcgcgacggccgtggttgcgatgcggggctgaaatatgcgatgatacgttttaagtcaaacaagcgaaatcaaacgcggacgcggcataatttcaaaacatcgaagagtgctgtcgattcccgggtcttgcattcctccttctaagagggacttaccccgtgagcaaatcactgcggaagataaacgctccatatatgcccaacaagaatccccccaaaaatgtcatcgcatgcctgaaatatccatgccttctggatgatgttctgtatgcgtgcctctcattgtgcactggtgatgagggaacccccccgaagtgatggtcacctgctcctccatcgtctgatagcttcgcgtgcctagccatcccgcttgcgtcttccaagacggtccagactgtgtgaaaagtgtaataggtggcaatgagtggtttgaacggcacagtccggagattcaagtaacttcctttccgcgtagaatgtcgtgcttttttgaaatttagcgagagcgtcagactcggagtccgctttgtctttcatgttaccatgccctcaaccaatacatgcacgaacccataccacggccaggctggaggacgaccaccttttgcaaacatg

SEQ ID NO: 8305 - DNA, 700 bp, Nannochloropsis_gaditana
  misc_feature (1)..(62): n is a, c, g, or t
nnnnnnnnnnnnnnnnnnnnnnnnnnnnnnnnnnnnnnnnnnnnnnnnnnnnnnnnnnnnnntatggcaaagaacagcattgtagattcagccatgaccgaggacgaggctgaacgaggggtgcattattaattccagtggctctcaataatacttttagattgccgtcgaacaacgaaagaatctgataacctttttgataaatcttacaacgctcgctgtcacatggttgacctcgacgaatttcgaacattcattgaacacggtcatagcctttggttttcccccaacaataaaaaatatcagacaaattcaacgaaacagggaggtgcgtctcgtgtcacgtgaaagcactttctcaggcttgggagttttccccgcgcgtggtaaggcaggggctgagaagatcggaacggccgagggccagagcaacgtacgcatcacttgcagctctctgcgccgggactccgaagtgggtttaaaaaagaggacccggtctgcaaagccgcggtgcctgggccacctgcttccgtgcagattaagtcttacgttagaagtgaactctagaacttaccttttctcgtgtccttcgcgttctcttgcagtcagaagttagctgagctgttttgcctccaaggagagtgtaagctgtcgctccgcgtgagggcaggtctttctcaagagggaggcgcccttaatg

SEQ ID NO: 8306 - DNA, 700 bp, Nannochloropsis_gaditana
ttcccttcttgagtcccaagacttttctctcagcccttccgatctggcccacccaaagcgacagccagcatgcagctctgaggaggctctcttcaatcaaagatcatgtgatcacgtgtgtgtgtgtgaggtgtggaagtggaggtgagtgggtgcacgaattgtcctcgggcagggaaccccttcatcaccagaaagctggcttcgcccgttacgagcccccgaatggcccccctcctcatgaccaaaaccctgtgcgccacgacggtagggccagcattttcagcaccgtcgacgtgcgacgaaatcgtcccgagcggacatgtgtaacagcatttaccgtcgcgcccgccctcgggaagtgaaagtgaaaaaaaagcaacaagtgggggtcccctttccttgagcgcagaggcctcagtcgctaacgagactcagaccaggacactcccatccacctgcgcccgaaatgtcaatcgcacccgtgtggtggcggccagtgcgcgcgtgttgtggtacattcgtatgctaaagcctcgtgttcacgtagattaaatgggttccttttcctgacatagctacagcacggtggaagcggagggaaactgcccgccaaccgcttccctgtggaggatattatcacgcccgtgtccgccttcaggtcgcgtatccaggatagaagccggtgcatgggagcatg

SEQ ID NO: 8307 - DNA, 700 bp, Nannochloropsis_gaditana
  misc_feature (496)..(505): n is a, c, g, or t
ccctccctccttcccacctgcctttctcctttccaggtcctttcctcggctgttcggaatgatgcgatccataaatacgcgccgaaggacttccacatcaagtgccaattctgcctcaaatccttcaacggtaggtacccccctttccccttccctatttcctctttctcgccctccctccttcccttcctcctctccctccttcccttccccctcctctttatcgtccatactcagctcttttcctttccttccttcctttcctcccttccttattttcctgcctcttttccctctttccccttccccttcctttttgtcatccatgctcagctcttttcctttccttccttcctttcctcccttcctcattttcctgcctcttttccctctttttttttgccttggcaggcaaaaacgcccttcgcaattttgaactacacgcgattttttgggaactctacctcgcccatcccgccctccttcttccctctannnnnnnnnntacttctacgcctcttgtctcgcctacaccaagggcttggctacgtgggtgggcatttgggacatcgacgagttcctggtaccacgtgacgagggcgcaagcacgattgtgcaatcgcttgacaccgtgttaacaagggctgggaaaacagcgaaggacgtctgtttcatgtctttaacgtcatttggcttcatg

SEQ ID NO: 8308 - DNA, 700 bp, Nannochloropsis_gaditana
  misc_feature (1)..(235): n is a, c, g, or t
  misc_feature (400)..(409): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactggatccatggcaagctcagcccgacaaactgcacctctgtgtggcgggactgaacacaaacttcacttgtcccctgctcgatcagacgttggagtttgtccagtaccatacacagcaaggcgtggcgcacatccacctgggagtcgactatcctgtggggnnnnnnnnnngggagggagggagggatggatggagggtgaacgaacaaaaaggcacgagggaggaagggaggagggaagtgagggttgatcaaggaagggaatggtagggcaattggcaatgaaaggagaaagggacagcaagacagaaaaaaataggatccaggaagggttcatgtaccagattcacgaccgtcgacctcaacctcacctttctccctccttctcctcctccccccttgtctccatagggctccacggcgcttcctccctccttcgccgtgtcctcctttttctccctcc

SEQ ID NO: 8309 - DNA, 700 bp, Nannochloropsis_gaditana
cacttggtcacacatcggcgggccgctgctctaagaaggagcatggctgtggccaaaatgtaaattagagtgagtgaacgaacaaaaacccttttagaggagcttcctgtgttcgagaaggcgggccttagtgtgaaaattggtcatttataactcagcaggacatgtgcgagtcagatcaacaggaaaagcagcagagcggtccgttgtgcgtttccaaacgtatttttagcaacacattagacaaatcaaccccccttaaattctcataatgccttttcgaaatgtgccgaggtattatttatctaaatgtcgaagaaatgtggtcacgttagggtgaaaaagaccttttttggcgtcaacgatgacccgtgcgtcttgtgccggagaggggtatcttgaggagcgtaggcaacgatctttccctccgttttgcctttctgacagagagccagtttttttacgccaaaggtatgccagcatgtaaataaactatcttccttttcattcacgtgggtaatggcgtctctggcctcgggtgggcttataagtacactgtgagaaagcatttttcagacagggcccgctgacgcacacgctccttcaaagttcagcttccgttcgacccgacctcaaacccacactttttgcacaaaaccatacacagagagcgttggacccaagaagaaggagggtgatg

SEQ ID NO: 8310 - DNA, 700 bp, Nannochloropsis_gaditana
cttttcacgaaaaaaaaagttgcaggggctgcagtgggtggtaaccgtgttcatgacgaatgcttgtgatttcgccgtcatccttggaaaaagaagccgcaagtaacggtatgcttcagcaaatgagcgtccaccacgatgttgtgagaccgtgatcgcgacaaataatccaaaacagcagcaggcgtaaaaaaaaggggaagtaataccggctgagcagaaacatacagaagactaccatgacgcctgcgccttcgctcaagcgtcccggacatcggcaaaccctacaatccatcttggacgcgcaagtctctttcacatgatccatgccgaggaagaactactcgaagtaggtcacaagatggcggtacattacgtattttgacgtcgtattggatgtaagacgcagacatgccggcacctgtggctcggatctctttttcttccttcataacgtcgggtcctgcgcttgtgcccagtatattattacaagaatttacgaactgttgaccaatttgtcctccatgcaaccatacagtccagcaaagagccctcaagtggtgtccttttcaagtctgacactctataaggcatcggcggaggccgcgtgtgagaagacagcacacccaattgtcacactgacctgccctcgtctactaagtccttgctcctatccttctttgggctactgagcagcatg

SEQ ID NO: 8311 - DNA, 700 bp, Nannochloropsis_gaditana
agtgtctgcagccaggattcattgcaaaggacacatagaaaggcgtattgctctttgttcacctccacgtcacgtcttaaccacccagccaggaggtcttccttgtgcccattcaagcaagatggatgccgcaacgccctatcctgcgcctcgttcttcttcggaagcagtcccagacatcgagaccggaatcgcagcgcctctccctctacctacaaatgccccccaagatcaaatccgagaggaggaagaggagttgtccggcaggccacctaccatggtcccagcgagcactaaggacaatccagacgaggacaaagtcccagtcggagccggcgacgaatcccccatgccgcgttgtggggagggtgtggcaagcacggccttccgtgcaagcggtcctcggacgagcggcgtgcacctccagaaagacaacgaggaggaggaggaggaggatccgctcatcgtcgccactcggacccaatgcctggggctcttacggaagctcttctacgtggtcatgccgctttccatcgtcgcctccatctacgcttgtttgtacgggtggatatttgtgaacacgccaacctacctgcaggatcctaccagctggcaacgctgtatcgtctacaacacaaacaatgccaacgccacgccccaaaacttcgccgtcagtgcctccgccttcggggggatgatg

SEQ ID NO: 8312 - DNA, 700 bp, Nannochloropsis_gaditana
  misc_feature (1)..(529): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccgcccccccgtcatctcgcaagcaggccgcagtagcgggagtaccgcggggttgaatcccttgcagggttctgccacagcccgggactgcgggggtagcacggccattttttcgaacgtccgcatttccccggacgcggtggagaagaacgagctggtgacggtgatg

SEQ ID NO: 8313 - DNA, 700 bp, Nannochloropsis_gaditana
ccaatcttacaacttccacgacagctacccgtcgagatgcgggcaacggcagcaattgtcttcatttgcggccccatatgaacgtgttgtccggacgtgtcagtgtcgtgttcagaataattcgccgtttccctttgcctttgctcccaagcctggtggctgactggccactgtccgtcacctgacaaaagggtgtacgtaagggaatgcatcgttacaacatgccatgatccgcaacgaattatgcctgtcctgcatggtgcgcaagtgcttttgcgcatccagatttgggcccaaaacgcgagcttgaagctggcgtgggcgagtaagaagacgagacctgtgttcttgttctccttggggtcacatacatcgacaacatgaagtcattgacggcgccgctcgttcttcccttgtagcatgcgtatcgacacactcacggccaggcaggcatttctcaggaagcgatggagggagggcaggggatttgtgtctatggaatgtggtgccggacttgaagcactgacatatcaccatcactcaggcgacgccagagggttattgtcacaaggcgaagcgcttttcatatttagcaaagtttcctccacaatttgaaatcgtagggcatttggggagcttgaatgaaaaagaatgcacgtgggaaaaaaaaacacggtcaacatcagcccttcctcggatg

SEQ ID NO: 8314 - DNA, 700 bp, Nannochloropsis_gaditana; identical to SEQ ID NO: 4543

SEQ ID NO: 8315 - DNA, 171 bp, Nannochloropsis_gaditana
cgcccggttgtcatctacggtggggccgaggtccgaaaccaacttcgggagttggaacgcggctgtgatttgctggtggcaacgccggggcgcctggtggatttgatcgagcgcgacaggatttccctgctttcgatccggtttctgatcttggacgaagcggacaggatg

SEQ ID NO: 8316 - DNA, 700 bp, Nannochloropsis_gaditana
gtccgcgtccttttgtcgagatctagcaatatttcggactcgcattgaatcctcgtggaacaatgtgttcttgaagaacacgtctccgtcttgggcgagaaaatatccccgacgacgagccaagacaaccaagtacaccatgtgaaagccacccagtcgcgtttgcgtccattttcagcaactctcacatgtatccttgtaaataatgccaggagtgctacctgtgttcataacctgaaaatacctttctctgagagtctccaaaaaaatatctgaatctcctctgactcgaaatggccctaaatctcttccgacctgcaccacacagattttcatcttaccaccatcaacatcatgccgactcttgacgagcgcttagctgccatggatatggacaaaagtgccgacgatgggccccatctcatgtcgcgacagtccaccatcgcccaccccctggaggcgacgtatggatacaggtaagacaaagttaaaaaataaaacatccgttggacgtacagtaatcgatgcgcctgacaataatttatgggctatgatgcgcgttgcgtcgtttggttctcgggaaacctaaggattgggatatggcaaagagtcttctaggtgctgctgctcacttgcaaccctccacgtccgactgaactctttcttcagttttggctacgcgtactgcgctcgaaccatg

SEQ ID NO: 8317 - DNA, 700 bp, Nannochloropsis_gaditana
ctccacggtcccgctcgttccctttatgctcacgcgtcttaggccagcatcgcttggcaagggagaatttgaggtgctcctattaaagctgctatcattttcgctgtcatcgtctctgctgctgcttctgctggtaccgatcggagtgatgtgcggtgtagagggcgggaggctagcctgggatgcattaggaaaaaagctgccccacaaaaggacaactgtaattgcgacgcaatttttattgcaacagcatgttccccttacgttccttcttcttttccctctcttctgcggcttgcttaacaacatgctgctgaccctactcgggcctgacatggggaagggatggaaaagagctaatgagatgcactgtgttatatcatgccagcagggtataaaaaagcgtgaaatatgacaaaaatgtgtttccatgcatctcatttactcgtctatcgagttgttccagcacactgccttcctgtggcccagggacggaaaatgtgtacatgtgccatatttaatgcgacgggcatcgccaagtcttcctcttcaagtgctacaagaacccatgagacgatttggaaggaggaaagacgggccacggtggggttagtacactttgatctcactccagacatattttcagttgtagaactttgtacaggtagctgggtattgaagtggaaaggatttaatcatg

SEQ ID NO: 8318 - DNA, 700 bp, Nannochloropsis_gaditana
tgcactaccctccccaagccgtagcgtcacgcaatgcgaagctggattgtgctggtgatgtggaacagtgcctagagtccaggaagggagctgtggcaaacgaacctgagacggacggttcaccatattttagtttatttttctgcttatcacggtaccatggcacctttgcccatatatgaaaacgcagcatggtggaaaccgccgcccgggtcatcaattttagcggcgtccttggcacggctcccaccatcgccacgggagcaacaggagtgaccgattttcgacacgtaaaacgtgccgcaggttatggagaggcaagcggcaatgaggaaggggggctgatggtttggggacatgggcatgaggctccaataccctctaaaccattgcagcagccagaggagacgcactcaaagcagggagggaaaaagaaattgaacaagcgagggagccagaatgaggtagatgagcaggaagttcctgattcagaagaggagccagacaggtagagtggggggatagtgtgcttctgcccatcatgacacgtccgaaaaggggagtcagcgaaacagatgacgcagtaaatcccattcatacccgtacactcatacccgtacacacattgccatgcccgtgcacacatcgccaccaccccaggcgcctaaagccaaacgcggacgctctgagaaggatcatg

SEQ ID NO: 8319 - DNA, 700 bp, Nannochloropsis_gaditana
gcttgtgaaagattggatgtcctttcaaatctagggtgtttaaagcggtcgagtaggtgtagtgaggctgttattggaaagaaactagcaaattattacgtgatatcgtgctgtccgcgacagttgttgctccaaatttccttatggtccagctttttgtagaaaagcatccattgctgttgcctagagacttcaaataaagacatatgatctcattcggtcgcaagatacgaattaaaatagacacagaagctagttgttcctgtcaaagtgtgtcggggggcccaaaattttggtttttggaaacgcaggatttagtccctccacgagaaaagcgacagctgacttgttccatggtaagcctccagccttgccactttttccatccaggcgccgcaacttggtcaaagacctcgtccacgcgtccatacatccgcgcgcgtgcttctttgttatgtttgggaaaattgccactgtgtctccctcgttgttgagcatgcgtggctgggggccctgccctgacaaaggggccggaactggttcataaatgctgtcacaccacggaaataggggaggttgctcatcaaactccttgcaacagtcccgaactgacaaagcccatgtaatctccacactgtccactctgcaacagacgcagccgttcttacaggctcacacgatctcgtcctacgcgatcatg

SEQ ID NO: 8320 - DNA, 700 bp, Nannochloropsis_gaditana
caatgcaacgcacacaccaccacgatcccatctcctcattgtcacgctggccccacagtttgatgaaccgtgcgggcattatgacttgaagtgcatatgtcggtcgctgactaacttatttctcttctgctgcttatatcgtattgccaatacatgcctggttaaaatcaaaaatgaagagcaattgaattggtaccatacagctgcatccagcttcaccgtacacgtccttaatggctcgtcaaaaagtgccaagcacttgtcgtagtttgacgtcaaggtatccacacgggtgggacgtaaattcttgctcgctgttcttttcggggccatttttgggcgtgctgatgccatgcgaaattttccaacgggacatgaagagtaatgatagggatagatgctatgagggattgtccatttactttgactgttttgtgcgcatgtttcctctgacatggctttaccatgcaacacaccgacctcctctttctagacatacgtactgccttgaagaaacaacttacgacgaagcttttgtggagcaccttccgaaatgactgatttggcaaattctcaagttcctaccgacactgcgaaccgtatgcgacaccctcaaacggagcagggtaaagtcacgcggcctttggagtcagcagaggagaacgcgaccggcgcagtggggtgggtgaaggacaagatg

SEQ ID NO: 8321 - DNA, 700 bp, Nannochloropsis_gaditana
  misc_feature (378)..(446): n is a, c, g, or t
tccacgccactccacgcccctgaaggcacgcagactgtctagtgcagacaataagaccacggggggaagcatagaaagagtattgcagggcaaaaattggatcctgacgaggcatcatttcccgcaggcgtctctatcgagctccagagtgagaacggcctcctcggcatgggcccctacccggaggtacttactttccctcttgcccttccttcatccccgtccacacttgtccactcatttgatttatccctctgtctatgttcaaccccgtctcggctccttcccctccctcccgctacacccctttctccttcgctctctccatcccgtcctccctccctcaccctcgcaacgcacctcttcgcttctctaggnnnnnnnnnnnnnnnnnnnnnnnnnnnnnnnnnnnnnnnnnnnnnnnnnnnnnnnnnnnnnnnnnnnnntccctccccccctctccccgtccctccctcctccctccagccctcccatttccctcagtccttcctctctttttctccccttgactgctttgtgattcatccccactgcccttcaacctatctcaagcacattaccatgagaaccatctctcccccctccaccatccttctcccgccctcccttcctccccccctcaggcatgggaggcgccatggatttggtcggaagtgggaatcgggtggtcgtcaccatg

SEQ ID NO: 8322 - DNA, 700 bp, Nannochloropsis_gaditana
agtcccgctgctgcatgccgtcccggtaccacattaagaagatgccattgcacctgttacgaggagggggggctgtagagtcacaaattaatggcagcatcggccatcatcaagagctaacatggttttcaatcgcacacagccgtcgctcaaactttgaagtcgcttaaaaacggcgtgcgcgggttggctttgcgccttaaggcgccttccgaggcacagggatgatgtgaaagtgaggaaaaatgccagcatggaggcagaacacaatttcaaaacatgcaagaatatggcaacctcggttgttcaaaagttttagatgtggggcgtctaaaagtcatcgccaatataggcgaccgtgtcgaccttgggcaacattttcttctttggaagaacatgtaaccaggtgttctcaacgaaaacaaaaaaggaaatttcaactttagatacagcatattgtcaagatggttaaatcttggggatgggaaaccgacaaccgatgggacaattttgcgattccgaggaaaatacgcgacctactgcatcgctgcctgctagattgctgtcgccttcaacacaaaaatatgccaggaaaaacgaatcacttgtgaatatataagtaacttctcacttaactgctcttactgtcaggactgactgaattatcttcccttccaacactccgctatgatagttcatg

SEQ ID NO: 8323 - DNA, 700 bp, Nannochloropsis_gaditana
cagcataaagaataaaggcatcaggctcgatccttgtaacgctaccacccagcctgcatgatatctggggtccccaaagcaatgaaatatgacgatccacacagcagccacccctcggagtcctccatgggattgcatgtccactggtaagggtctgagcggagagcttcgcggtacttttggggctgtgatgtgattggacggatcaaacatgccagtatgcattactttggcattatcgtcatcgccctttgcttcccttgatttggcgggagaaagctcccgccttgacaacctcgtcatcgtgactccgcccctccctctctgccctgtaattgaacgagaaagttggaacttagggtcatttttgtgaaactatcgccagaactcggaataattttcctcgtttattatgcatttgacgagaaagatgagtatggtcgacaatcactttccgggacgccgaccattaaattttttggttcggaccttgaagttttgtttggtttaacggctcgttgaccgttacgcgccctggcatcatcagtcgcgccacaatcaccttgagacacaaacatacttggtccatgccattagtgctttcctctccctttttatcctcacatcatgcgtattgaactaagagacgtgcatttttacacgcgcacaggttgctccggtgatcgtgtagttcgagatg

SEQ ID NO: 8324 - DNA, 700 bp, Nannochloropsis_gaditana; identical to SEQ ID NO: 6735

SEQ ID NO: 8325 - DNA, 700 bp, Nannochloropsis_gaditana
aattatgcacgatgcttgcatgctcggccatctattttcaaagctagcatcgatgaagtcattttagggattcgcttaggtctcaggggttgtttgagcattgaaagcaatgacatgcatcatgatgtagtgtcctcctcctcgggaccgcagacgaaatgggccggaatggcttgcatggttttctggtaacttttttcgacaatggggagaattgcacttttaagagcggaaatggctaagttgaatcgatttgttgacatgattattcttaagccatcaaaaaaaggtaacaaagttggtaacgatgctcagcaaatctgaggcagctagcaacccagttccgagctgcttacagcacacatcccatgccaatatgatgctgatactcgatcccgcataggccactgtgcacgggcttcgaagggcagtatgtacatcactatattcttgcatcttcaattttgcttgtttcgcatttgtttctcctgcttttacgctgcggtcgaggtttttccgtcgcccatgtttgctcagcgataggattctttctccaccgcccacagccaccaccgtgcgggcggggggaattctatgcacaattgtttagactatccttacgctgcagttgttatcgaacatttcacaggccaaaaacaggaagacaacgaggggaaatcgagtagctgcagagaagatg

SEQ ID NO: 8326 - DNA, 700 bp, Nannochloropsis_gaditana
  misc_feature (182)..(191): n is a, c, g, or t
  misc_feature (662)..(671): n is a, c, g, or t
tgaggaagggaggaagcaggaggagccgggcggaaggggagtgagcaaggggagggagggagaaaagacaagggagacgctccgagcatgtatctacatagaagctacgctctcacgatgcacatcttctcgttttcttgcatgtttttccattctacctgcactccctccctccctccctnnnnnnnnnngagggcgagcgggagtgcgggcgggaggaggcgggggaaggagaggaccgtcacagctggcctttcgagatggacttggagcctcgtcactccgctttagggagcgacgcagggggggggcatggaccgtccctggtggtggagaagagagagaaaggcagaaaggaggaggaaatgtgcgaggaggaggcgctctcccctttctcctcctcctcctcctcctcctccccgtcctcctccccctcctcctccccttccttgcaacacgaaggggtggatgcagccgggcagacacgtcgccaccgggaccgccaggaccgggccctagagtgtgagcagcggaatggaagcattgtcctggctcgtcccaagggggggcgctcgcgtcaggcagcccacaagcacgaggaggctggcgctgagacccgctctctccttttccagaaggtccttcctcccttgccctgccgnnnnnnnnnnctccatgtccgggaatgacaatgcccatg

SEQ ID NO: 8327 - DNA, 700 bp, Nannochloropsis_gaditana
cgcgttcgtcggccaaacgccatttattattttgcgcctggagcttttttagcagatataagacattggaagtctggttgaactcagaagcgagcaataaaggtgtccgaagacgagcgtctcgcaggcccaggctagcattcccttcctcgaccaaagccttcacaaggtccgattgtccttctcttgtgacggcaactcccaaaggacttcgaccttgctcatcttggtagttgacttcatcgaggctgatcggaggagacgatgtaaggcgagagattattgctgcagtgtcgtattctttgatggcattcgatgcaagaactcgttcaagcagcacggaggtcgcggggtggtcgatagagagcatgcgattatcaattaaatcatcaaaagcgtctgaatttgttttcataatagatatgtgacttagcaaagggacatgttccgtgttattgggagaaggggaacaaagaaatgaagcttttacagcgaccacgtactgttgaagttttgacctcccggaacttattttccgctttttttttaggtacagatctgaccaatattattgttcaccaggcaaattacagggcagaatcagaagttcttgaattttcctactgatacggagatcatcatcgtccgagcaaagtcttgacgtggtcaagtgcaggtaaacgcacccttccactccatg

SEQ ID NO: 8328 - DNA, 700 bp, Nannochloropsis_gaditana
gtaacaaaaccatctaggtcacgaaatgtacagcggtgatgaaaagtcagtgttgaatgcaaaagaaataaaggatgcattttcatctatttatttgacatttcattgcttttggattatttctaaagtataatgatttgaccttgatatctttatcacgaatcaattttgtagatgactgcctcaggtatgatggctcgctttgaaaaggaaaagagacggaggtgagctcaatataatttgtgcgatctctacaacaatgcatgcggtcagaaaacttggagacgccgatagtataacatatgtgtacaaatggttcaaagcgccctgatttgccagaatattttcgattaaaatatcacgaaagcaggagagtttctgatgcaacggagaagagtcgagactaaattaatattgtgaccaataaaaatattaattaagcattaatgaccacgctttgacagataatagcctattaaaagatagacaagtcctcaaattcctccatcaggaaccgttacaccgtcacgcgaccgttaccatccccgagacgtcggcgctctccttaagtctccaacccccttgttcctaccacgcttgtccgcgcaatttatattacatttgagggcacaagcgtcattcagagacatactttacacaatacttgtaacagtgtcgcttgaaatctaattgaagtatg

SEQ ID NO: 8329 - DNA, 700 bp, Nannochloropsis_gaditana
caacagacattgagatggacaagtcgatataggacggaggaggaacgcatacttcctagcagtgatggacgcacagatggcgctacggccccccctggcgctttttcacgactacatgcgtcttctagcggtgcatgcacatagtatgccacagttggtgtcatatttttgctgttggtgtcgtttgcgactttttacggcacatcgatgcctcggtgcctcaattcttttcgttcacgtcaaagttggctgatcgccgcacatccgcgatgagacagacagagcaggctgctcatgtcataaggcatgaagaaaaccaaacacactcgaatatgacggcttggacgacttgtacgtcgcgcgtcaagcgttcttagaagtggtagatgtcggagtccgtaaataaatgaagcggttttgtttttctccacgtcctacaggataagaaagaggcttttacttgatttttataacccgcatcaacatccttcaaccccgcaaagcgcatagttcgcgcgtggtacacaaatatgccatgaaatcttgagtgttatatatcgttcatcaacatgaattgtccgtagtaattgcgcatgcctcgcatgctgccccctgctacatatctcgcttcgcgaagtatcctattaaccatgcctttcccttccatatttacaaatacaaaacccaacagtgattgatg

SEQ ID NO: 8330 - DNA, 700 bp, Nannochloropsis_gaditana
ttaattacatatttttcaggtaaagaagatcgattccacagtgcatgtgtgctctaacctgcccatggtatgtgtttggcaaagacataccacgcatcctacgcgttcggtcattcaggggatgaagtggaggttactagaaagcacaaaggtaacaagtgctgagataaaggggtcacaatgcttgatacaatggcttggaacggatgaatttttcagaatgtatatttcttttgaaggaaaagacaaaaatctgggtatgtgaaagcttttgtttcgacttatattgccgaacaaaaatttaatttgaacatgtgcacacttcaatagcgtgtttttgggcgcttctatttagtggcttcgcatctatttgagaaaagtctgacacagccacattcggccgctgacatggaattgaccgacctacgaaaccgtgggacacgaggtgccccaaaaatcaggacgacatcgaagcaactggcgaaatgtggcctgcacgtatccgacgaaattctgtgctatatccatatggaccgacccaggaatgcgataagtgatacgagcagtggcagggcctcgggcccaacctgacctatatggttagtttccttctcttcaattatcaccgtcaagtaggggctcatcggtttgcatgttaccagatatgaatttttagatgttaacactggtgtccagactc

SEQ ID NO: 8331 - DNA, 700 bp, Nannochloropsis_gaditana
  misc_feature (1)..(644): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtcactcatccctgcacgctctgccaccggacccgcttttttgacagacatg

SEQ ID NO: 8332 - DNA, 700 bp, Nannochloropsis_gaditana
tgggagggatacatggcggcgaaagtcacgtcaggctgcggaggagggaagtgcgtcgggggcgggggcgcgggttggtattgtccataagataaataaccatgggaagggggtggaggagggtaataggctgcgggggcgtgtgtttggatacgtgagggcagagagagaggagaggattcgatggggagtcagtcgccctctcgcagtcctgcgagcactgaactgcccgcaacttgcacgccgtggcaaggaaatcaacatgaatggtgtgtctacctaggtgctcgggtgcagcgatgcgggaaaacaagatgtttgatgcacaggtgtcgtcgtacctgatgatggctgctgcgagtactgcccgtcggagggctgtcccggcccactcccgtgcgtggggcctccgtacatgcggttcacagcttcccaagcccggtattctcctgtgttgtgctgaagagggacgcagaaccgggtcgggcacgggagggggtactgccagaggtcatcgagaatggcaagacggggcccggcaaagaaagggagtgagcgagcgagaagaggtataactggaactacccgccaccatgttcctgctctgattctcccgtttccgtccacacatgacagcataggccagaggaaacatgtcggttccctctttttctgcccgtggacgacgttaaaaggaggg

SEQ ID NO: 8333 - DNA, 700 bp, Nannochloropsis_gaditana; identical to SEQ ID NO: 4694

SEQ ID NO: 8334 - DNA, 700 bp, Nannochloropsis_gaditana; identical to SEQ ID NO: 4695

SEQ ID NO: 8335 - DNA, 700 bp, Nannochloropsis_gaditana
gtcaagtagggttgtcaaattaagggggaaaacgtcgcaagccctaccggccatccgccaattttggtggtgtatgcatcctctgtcattttagaaccctctgaatctgaactgatttcctttcctgggacgccgagccagacgattttcccctcgcatgccccgttcgcgctgccatgacacccctgctcggctttatacatcgtggcagcagctcccttccccactacaggccctggtcggacatgagtatattgtggtgataaagatggtagtgagctgtgtgcagccatggtcgcggggcttcgatggttccgaaaaagaagggacaagctcacgcgtgcgtgggcccgcccggcccatatgccagttcattgccctcaagaggcatgcaagcatttcttttccttcgcgtccccttaccccacgcgcgcacgactgtacacatgggcatgaaaatggctgtgtagttagcttcaacttcaattatggaaagttttgtcgtaactagtgctattaatgcatgctccttgtcacgacgtgcgattgtgtacttcgcctctgaggcaatcatgtcacctgtttgagtcataaaatagacccctgtcacttccacataagcacagcaatgcgtctaccgtgtgttcagggacctaagtcgacgcatgcacgcagtttattccctctcttcttcaagatg

SEQ ID NO: 8336 - DNA, 700 bp, Nannochloropsis_gaditana
ttttaatgactctaatttggtgataacgcacctggtgtgatgtactcgtcagcacctaacctggcgtgggggctttgtcgcctgttttcgtgttctccgacgggctgcaagggttcacctcgcgttttcattccttgttcttccatcccacccccagaaccatgcgtgtactctctttccttgctattatcggcactgccgctgccttcgtcaagcccaccctccctgctgctgggtctcgcactcgtgccggcgctctccggtaagtggttccgtctgtcccacgttgaacatatatctaaatttcatggaatcatgcatgcaaggaatggtgcgccaaagtggaaatgtacgcgcttattcgaaaagaatttatcacaattgcttgcatcgtactatgcatactttgtctttctatcatgtgtcaaaaggaagcacttgctagggtttggacttaggcgtggtatcttctccccgcatcttacaagtgtccctcatcaaactgagggtttgctttgttctcccgactggttttcatagtccaattccatgaccgtttggagcttgtctcctgatgttttaaatagttctgggtgtgcattgcccccatttttgcaatcctgcttacctgtaatctcttcctctaacatgtgttccaactattttctgcctccctcgccttctctcctccataagcatg

SEQ ID NO: 8337 - DNA, 700 bp, Nannochloropsis_gaditana
  misc_feature (661)..(670): n is a, c, g, or t
ggccctgtccatcgcctttgggccccaccttgtcgcgcaggcccgtgtggcgtttttgtgtcggaatcacgagcttttgctcatttatttgtatgctgtctcggaattgcagctcattgctgccccgctgaacacgcgctggggcgtggaggagatttccgccgccctgagggattgtgatcccgcgatggtggtctgtgacgcggatttgtggccgcttttgcgcccaagtctggggcccgaatcggagagggagcgggacactgatggattgggaaagaagtgggaacgcgagggaaaaggaagaagcttcgaccgagaggatgagggaagggaccctcagaaacagccatcgatgatgggtttcatccggggtgtcgtgttgctgcacgcccgcgacgggggggaggttgaggcgggagtcgcgggtgagggatgtggaagctgtggacggagagagcccttctctctcccctcccgctccatccgctccatcagccacgaggcccttcttgccctcaccaccgccccctcctcctcctcctccccgtccccctccccctctggccctgcccttcccgccgaggtgcattgcctcatctacacgtcggggagcacgggcacccccaaaggggtcatgctcagccacgcggcgcaactnnnnnnnnnnattcgggcacaccccttctttgccaagatg

SEQ ID NO: 8338 - DNA, 700 bp, Nannochloropsis_gaditana; identical to SEQ ID NO: 4772

SEQ ID NO: 8339 - DNA, 700 bp, Nannochloropsis_gaditana
  misc_feature (94)..(103): n is a, c, g, or t
ccgtgttggacgctcaaacgtcctttttgtcgcgccattccgcgacagggaggacgagggttgaaggggggcaggaaggagggagggagggagnnnnnnnnnnattgcgctgtctcgctgcatacaaccgccacggtaaccattttcaaaaaaaaaaaagtatttgaattctaacggttgtctccttgcgtcagtccccatccaaaaaattaataaaggtcgtgataataatacgtagcctttctgtatgaaagagtgaaggatataaaccacattcgtcgattgttcaaatgagcggcctgtgcaagtggttcggcccctagcaaaatggaagggataagatagatagaagacgaacgcttcaagacaacggtattccttgtcatggctatgcgcttgttcctcacgttaaaagccaaaccacgtttcttcccttgttttgccgatgaccttacgaatgatatggcatggtcattgcatgcccgtcagctaatcttgccattcgaaggtcgggaggcttctcagatcgtaagcatggggaggcgacaccgtcatctttacaacttcacaagtgatttatttgatttttatatgctaagcacatgaaggattaaatatgcgagtctggcatactcacaccaacattcaatggtttgtgtccctcctatctttatttcgacaaaaacatagcgcgaccatg

SEQ ID NO: 8340 - DNA, 700 bp, Nannochloropsis_gaditana
actatggtcatttcgtggttgacgcccaactatacggccccagctccagccagccaagtgcgatacggccttgatccggacaatttagattggctgatcactaatcaagatgctttcacatacaccataccggcgggatacgccaaacaagatcaaaaaagtccctatccggattatacaagcggctggttgcacaacgtggagcttcgcaatctccagcccaacaccttgtattattatcaatgcggtgattttagtatccttccgtctaatggcgacgactatccatacacgccccccaccggacgttcagggacgttgttcttcaagacattacccgcagtcgggaagaagctcaaagagcctcttgtattcggcatggtggcagatattggacaaaatccggacgcgcaacgctcggtcttacgcctctcccagaacgatcctgccctgattctcatcgttggagacgacggctatgcagattgtgtgggtactctgtgggattcatttcttaatatgctcacgggcgtatcgtctttcgtataagtctgcagatgctgccgaccccctcacccattggctcatcacgctttcctccaaaccgatacacttacacagccctaccatgttggtggcagggaatcacgaggttgagtggctatcgaatgcaaccagtctcgagacccaaattttcatg

SEQ ID NO: 8341 - DNA, 700 bp, Nannochloropsis_gaditana
accggacttacatctcatcaatcgtctgaagctagtgaaaacaaagtaaagcactccaaacatgtaaaaaagacaaatggttttcctgtgacccacttagatacaatgtcaaagatgtagggcgctcaatggcgaagatgaagatgatatttagttgtcacacgtatatccaacatcttacggtaaaagaacaaaaccgggcccaaaaaactactcattacaagttaatttatcaaatgtttcaaaatgagcacaacatttatcatgtcttaaaagcacatccgcaaggcgcgcgaagtgatatatgatagcggggcgacccaggctctgcttttcgaaatttacttcgatgagaacggggcttatttccaatccggcgaataagtttaaaaggttgcctggaaaaggtttgtatcacttccacccgttgtagcttttgttgacgcaagataaagattggaaatgattccattttgggaacaggagatgatacgtcctggatagaaaattcagcgtatctgggaaccgttgagtttttgaaatcaaaatagagctttaagtccgaggaagaaggagtatcgaatctttttgctaactgacctgactaaatattctgtacccaagctattgaatgtttgttatgttttctactaaacaactatcataaatacctgtaacaatcttgattctatgttttagg

SEQ ID NO: 8342 - DNA, 700 bp, Nannochloropsis_gaditana
agtgatttggatggccgcaggcgcccgattcttgaccaagaccttgcgactcatggcttattgatctaaatgaagtcgataatgggaggatagatggccgggggaaagatagtaaggagtaaagggtagtccgtaaggagaacatcacgtgccagcaacggggtggttgacgatgataccaccactcacacctgggcgtgaacggcaacgttgcccatcaagcgacatctgaagagcatgacaagcatcattcaagaagagcacgaccagatgttcgtgcctgaggaacgtcgcaagagtcagtgtccttcctgatcagggcatagacggtcgacacttgtgagtccccattccatcacatcgtcatcgtcatcggaggtccccattccatcacatcgttatcgtcatcggaggtccctttctctgcaagcgataggaaatgaacgggatgtctcgtagaaggtgatgggctgcttgcgccggtgaatataatttgaataaattatgacaaatatatatacttgagggaccgtgtgacctccataatggaaaaattcctcctccatagcctccctttttaaaatggtagcatcttgttccccgatacgtacctcagtgcttcatcttccggaaaatatatgtaccaacaacgcgaacttaccattaacgtacgtctaccacatacaatattgcatggaat

SEQ ID NO: 8343 - DNA, 700 bp, Nannochloropsis_gaditana
agaatgagaaagcggcgaaaaaagaaaagaacactggttaccatcaagaagtaaaacattcgtccacactgcaccttaaaacttgttttataagaagcatagagggaatgatatcgaagtctcaggaggacgtgggatcggtcgggggctacactgcctagtgacctgggagggctcctcaagccgattgttacaagcacccagtcacataaaatccttcaatagcttttgggtggcgcgtattgtatgatctcacaacttacttgtgtgcccagggagtggaggagtgtgataaatttgcgtcctgtcacacttttctatacacccgttcctccagcatgatgtatttggtaggtcccgcttaccaacagggtgtgcggccatctgtgaaaggggatgcgtgaattgcactgctgtatcgccttgtgtgcttcgttagcgtggaaaatcgacattttactgtttttggggcgtccaggtggctatcattttttttaacaccccctgaccgcctgtcatcgagaatcctcgtggcggcagcatgggccaagctctcgtttcacgtccgtcctaaaagccacatgtacacgcctccagtcatctttcttcccactattcagaaaaacaactccaagcacgtccccggcaacaggtactcgtgattgccggtgtcgagccttccctggtactccgaaacgaa

SEQ ID NO: 8344 - DNA, 700 bp, Nannochloropsis_gaditana
  misc_feature (305)..(314): n is a, c, g, or t
cggggcaactgcttttcaaacgtttaaattgctgggggagggggggagcggttcggtaagagagaaggtgggggtgacgcctgagtcactgaaaaatggactttgcatttgtatggaaggcacctccccccctcctctctcgtcttcttgtctctgaccagtgtgctgtccctgcacctcccccaggtgttccaggaggcgatggaagcggaaggaaccatggcggccatgggtgcgagtgtgaacgagatcaacaatgtgagtccatcgccgggattcatcctcagctctggatgttgttgtcnnnnnnnnnnaggaggagggggagggggaggggcccagccagggaaacacccttggcgtttcttccgtcgatggaaaggcttccttccacctttcttcgcccctttctttcgatttttgggtctatcgcctgcccatccacctgcctggctggatcccctcgagcccttgccccgtaacggccgggccgttcctggagacttcgaatttttgaaagtgatcggccagggttccttcgggcgtgtctttctcgtgcggcacagacagggaggagtgttgaggcggcttatggaggaaggacaagaaggagggatcgggagcgagggggaagggagaggaaggaaagagggagccgtgtacgccttgaaagtcgtttggaaaacttcaggtgccctcc

SEQ ID NO: 8345 - DNA, 700 bp, Nannochloropsis_gaditana
taaatccggaaaactgaaagaagaaaaggaaagcggtcccggcaatgaagggaacacttttgtgcgccggtcattttttcaaaattttgaattgtggatcaacgacttactctcgagccgttagcaggcctcgcactccagcctggagtttatctttccgtcgataaatcgacattcggcaatttctatgaaaaaagatacatattcttgtgacagcaggttctacctaaataactccaagtcagtcaaattcggtagtaattctgcgaagagtagcattcttttaaagagctttcgagctgctccgttccagggcgtgtgttcgcaagatctcaggatgcaccaggacatctatggaagacctctgcgaagatgtttatcctattaaatatgatttcatcctttatgaggtgcatctcgcagcctctcgtgcatacgtgtgtcggcatgtttgtggtccattcggacgtgtcacgcgtcctgcggaaattctccccgctggagagttcccttatctcaagcagttaaacaatgtcctaaattctactcacacatgcatacagacaagcatttgattttttagaaaaatggctactgagatgcggatgcgtcctactgaagctgacagatacggcccgtagaaggtgtagtcaagtaattgacacctggtaagaggcaagaagcacataatttggccatg

SEQ ID NO: 8346 - DNA, 700 bp, Nannochloropsis_gaditana
ttacaggctcacttggtgggcgtggcaaatactgacggtcttgccattccacggaaaatagaatggtttaatgcacagcacatgagataccgcatgtgcaaccttttctatgtaaaaagcaatagacacgctattgccgtcatctctacattatgtttttttaaatccttacgacgacgtttcctttcgctcttgctaagcttctcttcagttggtggggtcacacagccggcgatcacatatgctctttctgatgctgaggtgcaaggtttcgcgtgtgtcttttactctccaaagggtcgatcatcctcacgttgcgggataattctttcatttttatatggaatattcatgccaaagtactcagctaccgagaaaagttgcacatgtggcatatgtggtgatttgcggggtcagtattccattcgcggacgtgacacacgaaaaagtgttatgaataaatgtgcccattccgcgcatcttgaacacatttctttcactgaagcctgtagagcgtagactcagcgtaaaaattccacatgtgtttgatgcttgccttgttattttatatttaaacaggctatatctactaacctcctcccacgttcctcgtctaggaagactcgctcatcctggtgcttctgtttcaccgattacccatctcatgtgtcccttgttatgccatacacttagaaggatg

SEQ ID NO: 8347 - DNA, 700 bp, Nannochloropsis_gaditana
catacaatatgtctccaatctcgacgcttctacaaataagattagagcgcgcacctgagatcactttcgtcagctttctatatagaaccatggtactgtcggactatagaaggcgagttccgtttctcgtcctcctggttatcaccccgctatggcttttcaatatgcacaacaagcggactggtacaaagggagaggtaagcatacattagagatgagacttgatggtactcgatctctaaaggacagcagcctttttaccagggcatcagcttactcgcgaactcaaagacgtcttatcagagtgttgcctttcctgagagagatcctcctgcgcgcatcatcgattgttttctgttcaataatgagcttgacatgttagagtttcgcttgaaggtaagttggatacatccaaaacacgtcgcagtcccgtgtacacggtacaaactcacttgtatcctcaacatcctggtagaccttggacccagtggttgatatttttgtcataagtgaggcggaaacaaccttcagtggacgaccgaaagatctgttttttgagcagaacaagaaaaggtaagagccatacttgcacaagattcgacatgtcattatagaggacccaaagaaacaagcccccgcttggcgaaacgaggcgactcagcgagacacctcaaaagaaattttggcgacactggagccg

SEQ ID NO: 8348 - DNA, 700 bp, Nannochloropsis_gaditana
tcttgtcacagcacaacgtggtgctgaagattctgctctgagggacgaccctagattgggcccataccacaaagcgtgtaggagctgtactcgatgcccttgtacttctactcattcctcactgatcatcttcactttttagtgtccttaatcatacttcgagctgagcatagtcatgctgtgcacaaagatgaggatgaagccgcttttctttctagtcggcatgctggccctgagcattacaagtgccgcacctgcgtttatgtacggaatcgatagattcaatgagattattgaatacgatccggttaataaagccacaagggttgttgaagagacaggtctgacgagagatggaggcagcaatgcatttggctttgacgaggccaggaaccaaatgttttggctctatagaggcgatgcttccaatcctgcgggcttgtactattgggatcaggtcaccggagccattgctcgtatcgcaagccaagcgcaatcgtggaacaatcaaaactttccggctaacgcggaattctaccgcgatcccagctctggcacttcatatttcgtttgggtcactgaaggagggagtacggtcaactttctccccatcacttatgatgtatccgacaaccctattggagttggaacagacattcaacgaactatcacagggcctgatttcagtccagacttcatg

SEQ ID NO: 8349 - DNA, 700 bp, Nannochloropsis_gaditana
tcgtaccgcaagaaatgaagcacagccaaggactgcacgctattaagtttcacattcaacttcccggagtcctgatcatccttttcatcctcgcaggtcattgcattgcggccaacatctcctatctcagcgggagaggggtgagaggaggctggctctgccccgttggcgagcacgatgaaaaggagaaggaaagacgaaaggtacgttccaaaaaagacatgcagtgctagcatgacgtttgaaagacctgtaagatgggacggataagtttgggaagaggaatgagccctcaaatgggaggggaaaagcgtgacggaaggagggaggacggatcaagcccgtatgggcctttaggcaagatgctggcggatggaccgtacaatggaaaggattatttttgtgtgctacggacgtcattcacgtgtgcatggcatcaagttgggatcaacctgcttattgaaataatagcatcgcttttaaaaaactgatttgagggattcattgtcattcgtgtcctcgttttccccgccacgctcgctcacaaaagttgctctctactagcgacgtcaacattcaatgttcccatccgacgccatctattccccgcacatacaggccaggcatggtgatgggacgccccgacacccaacgatggcgaggaatttgtgtctcgaggcgtaatttagcaagcctgatg

SEQ ID NO: 8350 - DNA, 700 bp, Nannochloropsis_gaditana
gtgctttcgaaaggagggagagggcgacgtccaggataaggggaataaatggtgccttcaaagtacttcaggtcgtccacctcggatgccaatgttttctttttcccaaacccaaagccaccgcccactcgggcaaggagcactgggacaactctgtgtgcgactagactctcgacggatctgcgcgatggtacagtgggcgaaacaaaggcatatagcgtacgtgctagtatcaggactgcaatggattgcagaaggagcgtattgcgttgacgagggggtccgtggggagcgtgcgcggacataagtacagcgaaagccacctgtttgattgagaggacaaaattagctcactgaagaccgacaattggggcgccaagccgatttgaaggaaattctagttccaactcggtaactcctgaggctgggctggactgggcgggaggtcacctagacagctgcaggctgctttccagaggagaaaaaaccttgtcgaagcctcgccttagcacatctacccacggcacacttgaatcgtggtttcgagagcatattcgagagcctcctggcgtcagtgcctctattattgaagcaaccagttcccctccgtcttcctcctcaggcccatcgagacgcttctccatttcaacatcgccgcacaatcggaagacttacctttacctgcactcttactcgcata

SEQ ID NO: 8351 - DNA, 700 bp, Nannochloropsis_gaditana; identical to SEQ ID NO: 6556

SEQ ID NO: 8352 - DNA, 700 bp, Nannochloropsis_gaditana
ggtacattaacttaacattgcttttaacctctatacattatcttatctatagctatatgcttcgtctgcagtctccatgattgtgcgatgacccagagttggacaatttatcttcagccgtccaaaagattttctcggcagactttgtcgagccacgataaaagtattgttgcacaattattcacgcgggtcattttctttcccctctatctatacttttcaggcacataactatccttttctagacattgttggcggaatttgtgcgaagaatggctcttgtttggggacaagaggtttggagtgttgaacgaacatcaagttttgaaatcgccgttgaacgaccgttaaagtgaccgtttctttccttttcccctcccccacccccccgaatgagcaacttggcggcgttgacgtctgggcatgggtaccctcaaggatgctgagaatcctaggttttttttccctattgtgactgctacgagtgattttttatgatgacgtgaaaaatcctttttcaacataagtgtgtcatgtgcatttcaccagattactctcttctcaacttctaccatcaaactttaccagtcgtaattgcgcgttgtcaagattcccaaaacactcaccttattatgcttacgactttaaagcaggactggggcgcccttatcccatggacaaatttgtcaggcgcctatcc

SEQ ID NO: 8353 - DNA, 700 bp, Nannochloropsis_gaditana
caccttttcactcggctgcgttttccaaccgaggtgaatatcaaacattttgttccacttcatactttggtcgaagataaaaaccactttaacgggaaaaggttgtgtatcatcccatattaatgcacactgcacgccattggcacgcagtgtcttggcatggcatattaaaatcgaagcatgcagggttaaggaactagcacatttttacttgctgccattttgttcttagaatgccgggaatcgcctggcccaatcaatcaatggccacatactaccagaatgcacatacgtgcacctagaaagccggtcttcgtcatcaatgccgacaaagacatggtcctttcagtggcctcggcccatatttttgaggttgatcgccggtcaggaggtcgagttgcaggggggggatcgccgcacaacacgatagaatacaccatgagacaagacccccgaaggacagtcgccggcatgctcacactggtttgctgattacataaaaaccccaggagcaggatgaaagcaactcgcggagacacgggaagtgcttcctccgacaaggcggcgctgtctccaccagcctctcgaccctcctcctcctccatccctgactccagtactctatctcaacaccttctctcccacttttcggactctccgcttgggagcaacgaagggaacacgacgaattcgacacatg

SEQ ID NO: 8354 - DNA, 700 bp, Nannochloropsis_gaditana
gacctcaataactctaaccctcacacgcacatgtttacccaccaatgtcccttctgttcacataatttgtcacagaggctatgcctacatcccttccctcccgtccgcaatacgttcccgtgtctacctgccccctctcaacctcctccgcccacaccgtccgtcctaaggaaattgtttttgaattgttccttcccctcgctcctttgtctgcagcacgacgtgcttcagcgtcctcgtcttcctccccttcttcctccgtgacgggccgatggattttaggaaaacgctacgatcccgaagacctggatggatggactcagcattttcgctccatcccttggttcacctaccgccatacgttcccgacaatggcaccgtacccttacaccgatgatgccggatggggatgcatgcttcgttcggcccaaatgatgatgggggaagggttgttgaggtgcgaacggggatggaggggtgtgcatgtggagacatagcggtgatttttctattcaaggaggatgcatgacggcgtgaatcgctatgaggagggcaatatttgtagctggttgcttgtaatttgaccaacatacaaggaaagtcctgtagaccaaacgtctggtgacaacctctccctccctccctccctcccttcctccctcccttcctccgttccccgtcgctggctttcctccgcagg

SEQ ID NO: 8355 - DNA, 700 bp, Nannochloropsis_gaditana
  misc_feature (413)..(633): n is a, c, g, or t
ccatgctcgttcacgccttccccttccatcctgcgtctgcttcacgtcttttccagcgagcaaccttacgggcgcggtactgggcgccttggtccgcatcgacccgtccattgaccccagctttttcttttccccctgggggttacgcaggacgaggtggggcaaaaggacgggcaggaggcaacgacaagggaaaagacggggggaaagggggaagagaaggaggatatgcctattctggacgagcaccgaggggtggtgggcgggaggatggacacgaggcgggaaacggcggacgccgggagggaggaaggtctgaacgggggagagagaaggggggatatgaaggggggagaaacgcagagttcggaggtcgaggaggaaggggaggaggaagaggaggagggaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggagggagggagggagggagggagggaaggaggaggggaccgggcggaggtgccgcgtgtgatg

SEQ ID NO: 8356 - DNA, 700 bp, Nannochloropsis_gaditana
ccaaaagggggattagagttgcctgcacacgtctcgtgtccttttcggaagtcctgtgtgaggacatcacacctaagaccagttcatcgtatcggatgcttcgtttcatcgatgcgaggggaatcaaatgagattggaggatgcgtgttgaggtaccgtgacaggcgtcccagacaaggtccgagacggtatagaagcaagagcgcctgaggcccgcaaattatggaggaccgcccgccgtcgcaaagctccttggaaagcccggaccagcatggtcgattgcgctgtcaatttgaatggtgagggcgtggctcgttgctgagaggacgcattgattgccgagtaggcaggggcacaagcagaggtgctgctagctctggagggcgagcaagtcgaccttgatgcatcaaattttcgacttggagggaaaaagattccccaaaaaacatttctggcgcagacaaggttgagacagacccctttgaataaacgtttgagacactattctatttttgacatgcctcctgtgcatgcattttgtccactccacctgttgtgcttcctcttgtgttcgccgcttgtcccaagcaccctaatgaaagagaagtgaaaggaattagcaatcactgtcattctgattggacgaggttctccgcaaatacctgcacacacaggtagtgaccgctctgtcgtgaagatg

SEQ ID NO: 8357 - DNA, 700 bp, Nannochloropsis_gaditana
  misc_feature (538)..(556): n is a, c, g, or t
agataaattatgcaaccgcccctcatcaaaatttgtcttcacggttcaccaagaaatctgcaaatgagagcaaagaaatgacaccacacacggggtgaagaagggaaaagcatccaatttgaggaattccctcaacacgagacaagggggactgggcgccatcgccatggctgacttcgtccaaggaatagcaaagcaaaggcttcaaaagagctgagcccagctgttgttgtgaagataagctcatggcacacataaattccatttgaaagaagaaagacgaccaagcatcgacatcgagctggctaagcgtccctccctccttttcacactttccccctccgtccctccctcatcctggccacgtccctatctgccaagggcagaccccatatacccctccctcacgccctcctctcccgccctcgtctgcccagaaatctcctgattcgtcctccttctccccttccccatctgtcttgacttttaacttcaacttttgtacattctagaatattctgtcaatcaaaacgcatcnnnnnnnnnnnnnnnnnnncaagggaagtaccgaaccttgaagacatgaaaagtggacattccatgtcgttgccacgctgtctgaccgttgccccattcccctccccttcctctcctccccccgtagagcgccaagggggtcctgacccagcacgggggcatg

SEQ ID NO: 8358 - DNA, 700 bp, Nannochloropsis_gaditana
cgggcagcgccgtcggggatggttgggagaaatgttgagcctcgtgcccttaatcgcacaacttttgccctggttcatgaccggatggccccactgccatttcattcctgccatgggcacgcagcaatccctttccctggtctcattcagactacgcgacgttttcctccacgctgcctttttcccgcttttttggttttttttgggagctcctgcacgcaggtcgcgagaccgacctcatgaaagccaagtcaaagggctcgcgagccactggactttctagcggcaatactcccgtccactgccgacaaccacggggcagcacagcgtctcattgtgctcgaaagcctcttcaaacgatacaatgcccagctcgtcaagtgttgatgcttggtctggcctcgaggcctttttacgggacgggggagacgccggcgcttggaacaccagggttcgcctcctcgggagttgacgacgtgtttgagttgattccacgatggctgagtcgaccgcatttgtggctacatgggcagccatgcgctacatgtcatgctctgatatttgcgtttatgttgacaatgttggtctcaacgtcccagcagctaagtggcaacccttcccctttacacaacacagccccccttcccctcctagtcatcgacctaaacatgagacggaatgaccacctctgtggcgtatg

SEQ ID NO: 8359 - DNA, 700 bp, Nannochloropsis_gaditana
ggcgcagccagtggtcgcaaaggaaatggagggggtatttgccgatcatcgtcgaaaagggatttcaaagaaatggctacgtcatcatcaaccagctcgctaggaccttggacctggtctttagccaccatgggtaacagaacctgctcatgcattacggatgaaataaagcgagttcaggtaacctgtgtgatatatcagccacagcatccactttccccttcgaaataagattggacctgtgaaaactatttcctccaagagaaaattatataagatcccttggaaaattaacctcctcccatgctaggtcgtgcgtcgtctcaaagaaacgggcaattaagcgtttcatggggtcacccccgcagtcctcctcgtttccgcaggcctattgttgagagcgaatcctacacatactccgctgcctcaaaagaattagtcaaatgcctctcgtgcgggttttgtacatgagcacgcgtctgtcgtggtcaacctcccctgaagctttggtcaccgtcccgggcctttttttatcacgaagagagttggagcatgcaatttctggccgcgcgcatcgagaaagcacgaaaaattgatacgtacctcaatattgatgtgtagggaatcagcccgggcgtgattgaaagcttgtgcatagcttgccttagagtccggtggcacgctcgaaaagtcacagatg

SEQ ID NO: 8360 - DNA, 700 bp, Nannochloropsis_gaditana
actgaaagaaaattgcgcaaaatgtcctgcagcagtactacaggactcagtgcgttgatgactaccgaaatacaatcttcgcaaaaaatcttaagctgcaaaggaaaaaccttctattgaaagactgtcaaacctgtaaaaggcaattatttctttttcggtggattcctcgatcgttccacccagttcacgcatcgagggcccctccgtgtctcgcaagcttgagtttcgactatcctcgaagagtggcgcatcatgtcttcctacgctgaatatacccatgcctttgtgcgagaggtgctgtcggtttttcgtattttactgctttcgtgatccgaggtccatcgagttaattcccggcagagggcgagtacccggcagagaggaacgattcgatgccagcgggcaagcccatagcctaaggtcaaaagctggataacgcgaatggacccaacaaaaacaccggaatatcataaaatgattgccagtggcgtacggcaatcttggcaatggaaaatacaggtttcacatgtttttcggacgtccatgggcttccgctgatggtttccatttcactcacttcagcccacaggaggcgcctgaagcatcctgtgctgcccttttcccgacgactttctctccactctagttggtatagtgtcgggctctagcgccttcaacattgtctttttgttggatg

SEQ ID NO: 8361 - DNA, 700 bp, Nannochloropsis_gaditana
  misc_feature (1)..(564): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtcttccccgatcaaaactcaggtatgagctctgtgatgtgattggagtgggatccacgtcaacggtgcaccgctgcgtggagcggggcggggaggggcgggagtttgcctgcaaaatcatcgacaaacggatg

SEQ ID NO: 8362 - DNA, 700 bp, Nannochloropsis_gaditana
tacgtcataaacggatccaactgttcatctctctgatgtacattcctgcacgagacctggggtaaaattacgcaagatactggacggtgtgacacaaatgtaattatttgcataagtgacgggtaaagcatgaaactgggtagtcttagccttcgtcctcccggagcaataataccggggcctgcgagcttagctgagaaataaagcaagaacatggaacggcatgccacttacttgtttcttggatccaatactttgccctggtactcatagtagtactatgaaaggaatacacagtggcttgagatgtatcaaagcctaacccagcttgttttcggatgctgctttgggactgcgtagaaagaggacgacatgggggacaggacctaggcagttttcctttccagatccacatctcatcggtgcaagcaaaaagaagttgatagaaaacacaggctttcgacggaatatactacctcttttcgctattgcgacatgaaagggccgaacacgtagacgcaaaattcagcaacctcccccccccggtatcttcgtcggcccataagacttcaagagccgtccgcttccctccgatcttctcccccaggtttccattccttattgattttcgtggtatgtcagaaacacttttttacgtacacatacatttcagattaaaataggactcgctctactaatg

SEQ ID NO: 8363 - DNA, 700 bp, Nannochloropsis_gaditana
tccccaccgggcaagtgcaactcacgtgcgatgtgtgcgattatgagctccccgggcagcaaccgacagtcgagctgcgccgtgctcaagatgatcccatcgttgtccccttcctctcctcctccataatggtagaagtcatgctgcagaggtggatcgtggccgtggtacatggtgtgggccgctcgaagcgagagagcgcgaggacagccacgcacccccctccaaggctctgttctgttccagaaccctcaattctggacagacaaggccctgtgcacgcaggtggacaaggttgaagtgtcagagttgaggcggcagcatcgtactccgtctggcaaagcgcgggcaacgcgtaggaagccacggcgtttcctgcaagtgcatttttccaaggacgagcaaccgatcgactcgatgagcttctcgatgcttcgcttttcgagggaagatacatccacttgaacgcctcgcaaggacacacgcggtctcgcacaatgcatgcaggaattcgatgttgtctagcaggtgaagaaacagtgtggcatgtgtctgtgccgattcatgtggggctggtcggcccaacttcttgcgaccaccgcgcttagcaaaccatctgtacgtcatgccgctgccctctcaacagcaactttaccttgattttttgattccaacgtccacgaccgacataggtaccatg

SEQ ID NO: 8364 - DNA, 700 bp, Nannochloropsis_gaditana
agcttacgattgcagtgtggaaaaatatttggaagaccatccgcacgcaatggaggagctggcggaggcccaagcggcagcagcaagcaccgggtcacaattcaccgtgatgaacgtccccgcgccggccgcggggaagccaaaatcatacaaggaattgctgagcgaggccaggcaaaagaaaaagtcataaaggcgtaaagctgtcaattttgtccaaatggtgcgaccgatatttccagagcaacacgggaaaaatcgaaaagtaacgaggcccctcatttcttgatttaaacaagaaacaaagagtctgtagctgaccggatttatcgttgccactgtttctcgcttttatactttcagtggctcttattggagaatgattttttgtcggtgtaacaatattctgttcgtgcgggccgagatacatcgcccagggagtatcacaagctttgtcaacctccccccttgctcttaagccgatgtgccacggcggactttttattgatgtttttctatcccccgtttgcgaagcgtaagaatagcttttctaagttacccgcatgtggctgtgtgccttggatgtacgtaggagtgtatcaacgcgtgtatagaagaacgttcagcctcttcctgcaagaccgtcctggcttaagcccccagaccacacaggcaaacactaaaaataaaaatcagcatg

SEQ ID NO: 8365 - DNA, 700 bp, Nannochloropsis_gaditana
aggaggaggaacgaaggagaagaacgaagagaccgaggatgtcgtcctgggagcgatcccatggtatccatgggagccatcccattgtaccgcggtgctctccatccgttcctttctctgcgccgacttatgtgttcctccttcctttcctccccttcccactccttccccctcacccagggcactcggcatgcacccagaggcccgaacccccccttcccccacccctccccgctccatatccctcgcctccctctctttcctcacggttctctccctgaagctcctctccatgctcctctaccacgccctcggccccgtcctcaaccgctccctcccttcccacctggcggcagaggggccctccctcctaggcgtagatcacgtgcttcgggtgccggtgccccctcctggaaagggagggaggaatcgaggcggggacagggacgaattgggcgacgattctcttttcatgacgctcttggtcaagaaagctctgcctccagcaggagagggaggggagtggcaaggggagggaggaggcgggagcaaaggtggtgtcgtaagggaggaaaagggtaaaggcaacctcccccccctcctcttcctcctgcacggctttcccgacgacgccagcaccttccatgcgcaggttctcccctttgctcgcgccggtttcgacgtcctcctccccgtcatg

SEQ ID NO: 8366 - DNA, 5 bp, Nannochloropsis_gaditana
gacgt

SEQ ID NO: 8367 - DNA, 700 bp, Nannochloropsis_gaditana
  misc_feature (516)..(525): n is a, c, g, or t
gtcctcctcctctccaccaacgccgtcgtggtcttcgggatcatgcccgcagccttctacgtccagggccgccagtattatgaccgttttcgcgcccacctctccctctctttgccttcccggatggtgcgagctgctgcccaccgtcttcttgtctccctctgcctcctcctgaccctcttcccggccatctcgaatttctcctcccccctgctcaccttcaagctcacgttcttcgtcgccgccatgcttttttacaacaccttgctctttctctacttcctcccgtggtcgcacgtcaggtttttccctccacgttaccgcatcatcgccgtcctggcccctcagaactgccacctggaggaggcgaccaaaaggggcgggtggagcggccttcccatgggcagggaaggccgcggcctcagcgaaagtatgcaaggcaagggcaatttttccaaattgaatgcgcgaaaattggaagccatcgaggcggcgggtttgtccatggcccagctnnnnnnnnnngagggagggcgggagggagggcgggagggaaggagggtgcagtaactgtgtgttgcggttgtccttttggccgtcgtcccttcctttctctgacgatgccttccacctttttcatcaacacatacccacacttacatatggaccctttcaggaagaagccctgtttgaggagatg

SEQ ID NO: 8368 - DNA, 700 bp, Nannochloropsis_gaditana
agtgcagctggggccgtgggaatgtgccgacgcccgggtaattgccgacgacttgatcacctgcgtcaccccgccaggcgtgggcaagaatctgacgatcattgtgagcctcggcggtttcgaggtgagcttatccccgggcttcacgtacgcggcccctctactggtcaccgttgttcctgacacggcgaacacaggaggcggggacctggtcgtcatgggccgcaactttgggcacacctcggagggtctccaggtctcgatagggggggaggcctgtcgggaggtgaaaatggtctacgaacaccaactgatcacgtgcaagtacccaccggggacggggaagggtcttccgatgctggtgactgtgtcggaccaatccaactcccccccccgcgccttcaactacgcggattcctacggacaacggacggtggaagccgttttcttcctgtttggcgagagcctggagagctttgggtcgaacaaacaggccgtcttcgagcaagtgctgctccgggctatggaatatgaccctaccctcagcatcgccgacgaagctgtgcacgtttgcaatgtcaccagcctggctggtctcaccgcatccacggtccaatcctggaacgtgagctttcaagggcgggcctatgccccaaatccaagcaaacaagccgtctccatcgacgtcgacgccgaaatg

SEQ ID NO: 8369 - DNA, 700 bp, Nannochloropsis_gaditana
atctgtttgaccattatgttcgcccatctccacggggtcggggtctgtaggggatgttgtggacgtctttgatggaagcatcttgttccacttgggggcccttggcggtgacgtgtgcttggatggaataaagggcatgctcaatcctgtgtctagaggaaggctgctttgggggaagtctgatggacttgttgtgggtgtaccatgcattcatattgtatactgaggaggtaatgggcggatcgaggcaaaaggtgtggacatgaatggcagtttaacacctcgtgcccccccccttaacacgatcttcctgctggccgataatgcgcctagagggcaagtttggtgatctcttgtaatttattttaaggttcgtattctattaagtggcaccttaaacgtatgtttgtgtatgttttactcgaatacagggaggtgcagcttttgtccttctttttcgcgacttactagtgtctggacgatcgacgtggaataaaagcattgatcctgcttcccttagaccggtcgggcacagacggcaagagccacaggacgtagacgggcacatctttctatttaaagagttattaattgaggcacaagatttgtgaggaagcaattcgttttcaacctctttgacccgcctttcccctctcggactcttctccttgcgctctgaccacctcaaggaatttatatg

SEQ ID NO: 8370 - DNA, 700 bp, Nannochloropsis_gaditana
gcgaaggggactgtcctgggtcagacatgggcggagaggaggacaccggactcatggaggcgccactgtccgccatggacctcttgtgtgtctgtacaaggttgaaaaaggtacaaaaggtggtgggaatgagccgtccaggcgcccgggcgggtggatagagccggacgatatggtcctgctcgatctcggcggcgttcagcgaggaaacatgcccttggagcagtcatcccccccgggacaataaatacgccctacgacccacgcttggcaacaggcacgttcgaggcgaagtgtggaaaggcaacgcggtgactgtaatgaaggcgcgtggggtgtctcggcgtgcttgttggtcgcgtatgcctttaaacaagaagatcaaggggtgttcggatgattcagagagtactcgcggcagcaataccactcttgtcctcggcagttttgagcgaattaaaagcagtgcatgcacgatatatttatgaccagttagaacaagtggaattggtggcaacctttttagtgttttcattcctggaagtgctgcaacttctgtatcctgcttctcgtcagacctcttggtaacctaacttcctgaactcattatccttgtccgcccggcattcaccacccctcaacgataaccttctttcacagactcgtcgcagggctgtgttacaggcaaagagcagccatg

SEQ ID NO: 8371 - DNA, 700 bp, Nannochloropsis_gaditana
  misc_feature (603)..(680): n is a, c, g, or t
cttcatgtcttcccgccctggctttgacctcttatgttttcatgaactccgctgcgtgaccccgcctctcaccctgcaatatgcctccttcttcctccctccctcctgtcatctcttcgcctatctcaatgtactgcccccgtttttctccctggtgggccctgtccccgaggctcacctcgtcctacctccaccctctcttccctccccctcaccactctcttgccctcccactcctcatcgtgctcgcaggcggcgtcgttcacgcgccgggtggcggtaagcatgtcctccatcctcgaccggaaaaccgaaaagaagcccaaggacgtggacgcatccttcggttcgggcgggctcttcacgacctcctcgcaggaacaacgccggtatgatggggagggagggcgtggtgtggtggggagagagggagagggtcgtcggagcgaagacgggttctggaagcgtggcatgtctcattgaacgaggaagggaaggagggagggaaggagggagggaacgggggagggacgaagggaatagaaatgaatgttgaaaacggacatgggaagcgtgagaataggagagggtaggcgaaaagcnnnnnnnnnnnnnnnnnnnnnnnnnnnnnnnnnnnnnnnnnnnnnnnnnnnnnnnnnnnnnnnnnnnnnnnnnnnnnntcttgcagcaaaaagagcgg

SEQ ID NO: 8372 - DNA, 700 bp, Nannochloropsis_gaditana
ggattttcctagtgatatcacaaaattctccgacgtgtttaccacaatcaggacatggggaaaagcgtcctcacgtgagattccccgtatcaaccatacaacgttgaaagctgcgagaccttatgaatttctggagcagtcacatacactaaattgcacatgtaaagcctttttttttcgcgcatttcaatagccgcgaggaatgtagtttagaatgaaaaacatccaaacatgttttcagcgtctcacttccccttgcccgtctctctcgcctacgaaaccagcgaaggctcatgttccacgcttgaaaaccgtgccgctcacgcactgcgggccaccacggacattttagaacaacttccctccttcctctttttctgaccagggatcaatgacggacggcagcagcaatggcactgccggtgaaagtgtcagcgctgtactgccactccggcgacgtgtgccccccgcagctcgacgccgtcacgaccgtcgtagacctctgccgtggcggcgggggcaagccgccttgtcgcaaagccttacaacgtcagactcctcccttattttccccctctccacgacgggaggaagccactatgtcactctggagatcgggactccaccgcaggcgcaggcagttattgtcgacacgggcagtgcctgggtggcatttgggtgtgctcctggctgtgacatg

SEQ ID NO: 8373 - DNA, 700 bp, Nannochloropsis_gaditana
gtaccatcagagacaacttcggctctgtgcatttgcccatttcttattgtaagaagaaatgttagaccacaattaagggcatcaaaatgcatttacttctgggaaagagaggagtaagacacaaagtatcgtgtttttgggagcatagaactttttggggggacacaacggactcccgacactctcaggctcaagataaccaggtctttaaaaaagccatataactcattaaacctcgattttatcagtaagtcaatcaaaaaaatgtaagataagaaatggggaacaaaatttattttgcaagaagagaagaaggaaaaaagagaccctcacaagcagagagggcagggacaggtactactcgcgtcacgcagaccccagaaagcatcacaaacgaaagtgatccaaacataagaaaatgaatagcatggccaataaccggtagtttggcctgtgtatccgtcggcttttgtattgtgatggtcgtgaaaatattctcggagatgaggggaagtagggcagtactctaatgcttcaaagcaccatgagaaaaaagaatttaagcccacgctgcccggtcctctttcagccacgacacttatcccttaatgagaagcatgtctacaaactctccttagcaatatattggtttgtgtcatgagaatgcttatcgttcagtacccctcctacactcgtagta

SEQ ID NO: 8374 - DNA, 700 bp, Nannochloropsis_gaditana
ccccttaacctcccacccctgcagctctaaacttctatctacgtgaaagaaacgcgttggtcaccggcttacagccaagaaaatgtacatagcgaaaagcgatcactcgtcaaacgggatgcaatccgcaccacgttcaacttgaatacttttgccggactcattcttgggaaaggtgcttctgggaagtgtaggttgtgacatgatgcttttggtagggacatagctgattatggagatgatggctacgttgtgtatgcacggatcagtcccgataggtagtaatgtatttatttttttcccttaagcatccaatatgttactcgtaagaacatagtccgggggttgttgtcagcaacgtacggataaactaccagtggttgtgcctcgatgggccgtgaaacggttttatgggccctcaacggtcggggtggcctgatggacaactcaagaagacggctcgaaagcaggggcacattcaattacattgcgcgcttttcacttggctgacgtgtgagagatagattgatttgtctagtgtcttgtaatacccttgtaatcgcccgttctctttttttaaagaaaccttctgctggcatatcattcgaaggatctgacacacctgtgctgcatcatgccacttccattacacctacatgagcaggtgcttggttcctaatatcgacggtaaatcacaatg

SEQ ID NO: 8375 - DNA, 700 bp, Nannochloropsis_gaditana
tcccttccctcccccaaagcctttctcgatcgttttgcctgaagatctccgcgttccccaagaacatggaggtagccatcggagaaatcctcttgacagctccagtcgcccaaggctgtcggttggaggaaaaagagctttctccctccgcctctcaggcgtcgcatgtgttgcacgtggttcattcccctggtaaggagggaaggagggagggagggaaggagggagaagcgtagggtggggaaggtgtgtctaactttagcgctggagttaaggtcttgttcttctccggatcctctcttctgtttgctttctttttgcgatgcgcatcctcaactatcgtcaatccagtgcacaactttgcgagacttcttgcatttaccttaaccgggccagaccagaacctttcttcgccaatgcacccaccctgaatgttttctcttcattcggggtccggagattggtttttcccggctcacttacccttacccacacctatccagaatggagccccctcttctactacggcctcacacagagccattccctcaccggccctacttccgcccctcctccatccttcctttccttcctccctccttccttcgaaaaaccaccctcctcctcctccctgccccccgtctcccgggcatattttaaaatgcgggaaatatgggaggagcggttggaggaagggatg

SEQ ID NO: 8376 - DNA, 700 bp, Nannochloropsis_gaditana
  misc_feature (1)..(69): n is a, c, g, or t
nnnnnnnnnnnnnnnnnnnnnnnnnnnnnnnnnnnnnnnnnnnnnnnnnnnnnnnnnnnnnnnnnnnnngggagggagggtgaatgagaggcgacaaagaatgcagagggcagcgggcatgccaagggcatgattctccaccgggacgctaagatgtcatcgttaggacgatggatgatttcaatttcatagggcgtgcgtgtttgacgagtaacattgatcgtacgtccatggatttccaggaacgtgcataatggagcattagggggggaaatggatctacgggacagcggtccgcgtgaaatcatggaatggatgaaagggaaagtgccacacatcccgccatcattgcacggtcgtatcatagtccttgctctggttacgcgcttgtgttttcaagcggtgatacactcacgtcatgcacacccatttacttcacggggaaagggaggaagaagagctgtatcttcatatcttaacctctctgtgtacatagaaccaaaaccacaaccgatttgacccggtcccacgcactcccacgtcctctgatggagtgcaggccttgccacaagccaaggagggcaaggaagcgcgtaaaacgacgggtttcattcccctgtaaaagccctcaggagacgacgacgacttgaaggctcgctccctcacccttcctttggacgcagggctggaccccacaatg

SEQ ID NO: 8377 - DNA, 700 bp, Nannochloropsis_gaditana; identical to SEQ ID NO: 6474

SEQ ID NO: 8378 - DNA, 700 bp, Nannochloropsis_gaditana; identical to SEQ ID NO: 6472

SEQ ID NO: 8379 - DNA, 700 bp, Nannochloropsis_gaditana
aaacatgcttctgggaggagcgtctgccttctcttttcgcggactaatccgtcgagcaagccatatttcttccttttcccctgcgtacctaaatgctatcgtcctataccacccttctttacgtttctcgataatcttcttcttcgcgtgtttcgttggcggaacgctcgggcggacgggtgtgtcgtattttccggaagtactccccatggcttgatggagccggtttactttagacacgtgcgtcgccccccagatcagctgctcgctactgtaagctctcggaaacaactttctggatctcatccgcccctccatgcctttccccccgtatattatacgtgtaatatccaaagcattattccctaggtgacgccttgccacgaaaggagcacgagggcgttcgctgcacacgagtgagggggattacctgagggaggatcttctccctcttggcctggcccccctctcgccccttccactcctcctgtgccctggacgcgcaggaggtgggaaacgagaaccggattggaaaattggacgaacagcgtgttagaccgcaccccacgtagctgggtgtggctcaaagccttgggtacctactcgagcaaaaagtcatcctagcaggaaagctcgcacgacaagacaataaggaaagctctaccgcgcctctaccaagacgcgttcggactcaggaatg

SEQ ID NO: 8380 - DNA, 700 bp, Nannochloropsis_gaditana
aaagaccatcatcattgagtggacaagcaacttacacttgagtacatggtctcaatgtatcttcgtatgcacggcctatacattgcatattcttatttgattgagcacgtgattacattagaaataacgatcacaagccttagaagtctacaaaatgttgatcgcttcgattcaaaattttgaatgaagttcttaccctgaccataattcgtagtgttgaaaaagtattcccgcaagaatgtcttgtggaattgaaacacttgtcattttttccaaatttgaagccaaaaacgtaaaagcattttattgtcatactttgctaccgtcctgcgccatgttattccaatgcaaagtgctaccccggatcatctaacggttcctccaatctataacggcaacttgaaattttaaacgagtccaattacgtcgaaactcgtgtcgtagatgcgtgcatccttctcggccgtcgtttgcctcagcgttgtattttttatgttattttttttacgtcaaaataacttgtcatcaagaatacaaaagtgtgccgagttgctcccatcttgacctcagcatgagctctgctatcctttgaccaacttgagccatttccgttctcctactgactatctggctcacgtcacgatctttccaaaaaaatctcaactacttctctttttctttatccaaatgaaaaggcatg

SEQ ID NO: 8381 - DNA, 700 bp, Nannochloropsis_gaditana
agcaacagcaaccggtgtacgtcttcggctacacacctcaagactcctcgtccacgtcctcctcctatccttcctcctccaccacttcccacccttaccaccaccatcaagccgccctgtccacgaccaccccttccagccccttttctggcccatcggccacgtcggcgtttcaacgcggctcgaccacgtcctccttgcctcccggggggggggcagcgggtcctggatttggcacgcccccgcctcttacctataccagcagcactccgattctcaccacccacggtgggatcccggtgcccgccccgaggcccgcaggcggccagggcagtgcgggatcgcagcagcagtcgtcacagcagcagcagccccagccatcgcgacccgggagtcagccctcctgtggggggggccagggcacagaccttggtactgtaggagggcagggactgacgaccctcatccacttgccccccggctcgtctctcccgcctctgggcggggcgatcaacatagggggtactctctattacccccagcaccaagtgacgggtctacagggagcgccgtaccagcagctcccacagcaccagcagcacccatcgtcattcggtcatggcgcgcacacgggccccggggggggggttcgttgcacagggaggacagtggcgggaccagcaaccttgacttctctatg

SEQ ID NO: 8382 - DNA, 700 bp, Nannochloropsis_gaditana
ggcgggaaaattatcggacaaagcattctccttcgagggagaccattgagacgtgtacataagacctaaaataatcgcggtgaagaggccggatttatgtatctctcaacgagaaaagactgacgggacatgagcaggatgaaggtatcaaagttgagcgtacacggtaaagaacgaactggatgcattatttttaagcacgccatgtgcctctgtgttcagttgacttcccattcaacctcccgcctgagagatcaagacatttcgttttcatcgtagcacagcccctcatctataagttgttggtgtgtgtctcaatgatataaccctgttcattcatattgatgtcccgcaggatttacatgatatcgttttgttcggatagttgtgtaaaactagctacaaagaacgtcaagtcagacccgtcggcgtcggcgagcgtcggaacatcacatggcaatgctcacttcttttcatttcgatatcgattcgtcgcatcattctctttctaaggtgctcagtcaattgggtgaatgggcagcaatgtatctcgcagcacaagtacgacagactccaccactgcttccaccggtttcacgtcgtcttcttcgccatcaaacaacgtggtagacctgtatggtggaacaaaggagctgaaagacgacctttctacaattattgtgcgcctgagaggggtatc

SEQ ID NO: 8383 - DNA, 700 bp, Nannochloropsis_gaditana
gactgcgtaaatgccgcaaaatccgcctcgtttgtcccttctattttctccacaaaactgccctgacaacgtggacaaatgagctcaccgctcatatctacaccattttcgtccgtgagggaggccgggacgcgctgatggcacgcatgacaccaccaggagtcgctcgtcgaaggaagggaggaggaggtagaggaggaagaggccaccgtggaagtgactgtacccggcattcggcagccgtcttccacgagaaacggctgtacattgccaagatagaaaggttgtgcgcgttatgatggatgatgtagggaaatgctgcgaaatgtggagcgagtgtctaggaaagcacagagacacttgaaggggcaccgaaaagcgactcattcggagggtgacaaataagacgataaaacgcaggcatccgacaactagacaagtcagacgcccattctctgtctagtgcacgacgctcagcgcgtcctatgcatgcattgtatgttccttgccgatggagtgcttcgtcttttgtcccttttttccttcaccaatttcatctgcccaccgttcggagtcgctgagacggtcaacgatgggccacattgacggcataaatgggcgcggcggaccccaaggacgctttgagggctcttttgtactcattcgtttagtcattatcctcgtgcacaccacagccatg

SEQ ID NO: 8384 - DNA, 700 bp, Nannochloropsis_gaditana
aaatgtccctccagttgttcacaaatgcaaagcagccttatcatccattcctgtacatcaaaatctgctctaaggcgcttgaaagagctcctaaatccctttttttgacattcactcagatccggtgggggggtccttttggggacctcgaagtggtgggtgcgccgcatgtgaaccaccttgttggatgtaggcggccctaggtttcgttctcgatgacttctccgttgggggagaaggcacttatatccagacagcagtaattactatcttacaacgtctttctcacaggttggtatgcgtccctgtggctaaattgtcttggactctacataagcagctcggtatttaagccgtcgcctggatgcccgcctccaccttcttttttactttttcgctattcccaattatttcaacaccatttgggcgactccgattgtgccaactgtcttgctgcttcattccaattctccttctcgtggtgctgtatccccgcgctctgctggctgcattgcacacagcagataacatggtcaagcaggcctccccccccgccacctccacctgttgcagtagagctcttcgactagaatgggaagacctgtgctgtcgaaccaagtcagataaaagcagctctgggagggaaattttgagccatgtgtctggacaagcgaaaccgggaagattgctggccattatg

SEQ ID NO: 8385 - DNA, 700 bp, Nannochloropsis_gaditana
gtaaaagaggaagagaagccgacatcccatgttccacgcggcactagtagcccgacagggtacgccgagcgtcctcgtccactcgtggctgtcaaacgtaccttcttaaacagtccaaacgcctccaggttctttccgtccagcttacgtctcgacaattgtgcgggttgagagccggggaccatttcagtgaagacgtcgctaggcttgggtaggtggtaaaagtaggtccagaacccttcgacggtcgaaaactcgcacaacgcttggtacgcctccttcccgtagctctctagagcttgtgttactgtcgggtaatgaagataaagctgccagggttgctgcaaggggtggtcctgcccgttagtgctactaatgctgctgctactgctgcttgttgttccattgtccatgacgtcgtctgtacaagtccacgcagcagcaaggtcacaaatgctccccactttgtctggcaccacacctggtagcctatggtggtcgggaaggtgctccaaaatgaaaaactggcgcatggtattgaggacatgctttattggagagctcgtcctatcttctcagtgacgattgtcgccactcccttgagcccggcccgatttccgtgcaaatgacaccatccggccttgaccggtgcgacatatgtgccctaccctctatgtttatcctacgtgcactccgcaca

SEQ ID NO: 8386 - DNA, 700 bp, Nannochloropsis_gaditana
ctgtttctccccctgacggggatgaggcttccaaagccatggccaaagccgcctccaagcaataagagcccttcccctcaattgttgcgtcgtcatgatatattacgctggtaattttgccgtttcttctggctgaactcatttctatagggtgtagcgtggaaagggttgtgggctgaggaggaggaggtagtcaaaagcgcaactcggaccaaaaaacttcaaccgacggaaacgtcacccgcttacaaccattatcatgctgacaacacgcctcttaaccaatatagcattcctatagcttacaaaggacctttgtttccctcttgattttttattggtagccgtctttattgaattgacggccattaatccctgtctggtacgggcgggagacaaggggggggaggaggttaacgcttccaggggggtaggaggcttgcctgcgtcagacattggagtatttcttacgcatgttgaaagcataaggagccgctcttaatgggtcggtactcttcaattgacacacgtggacaggacgccgggacttgatcattgcgtgacgccgccaggtgtcgttttgctggatttaccgtttccgactctcaagacgttcgggcaaaggacattgtcgcctgtcaccgataccctttaataccttcgatttcgctgcatctgaatcgataaacatgcatgtatg

SEQ ID NO: 8387 - DNA, 700 bp, Nannochloropsis_gaditana; identical to SEQ ID NO: 4789

SEQ ID NO: 8388 - DNA, 700 bp, Nannochloropsis_gaditana
ctcctccagcttctccacgctgtgtctaacacccgcatcatattccatccaccggcgttatggcctggaaacgttttcgtcgtgagaaagactgggatgatcagacttgaccttctttgtactcatccatttcaccgtgggcaccgcatccaccccctcaacagcaagcagcagaaaagcaagaaagatgggagactacgacgcgtatggtgtcccggcccccgttgctgaagcccctccccgcccaacatctccagggcaaagcgaagaggtacgcatagaattactgaaaaacatggtgataggggcttggattggaaaaagtggcagatgcgggcgttccatggtccttctttgatgatcccctctgcgctcacctgatgaatcgtacgttcgcgcctggttaagttttttctcagagaatatagttggtgatacatgaaattcgatgcctcactgtttgatcatgtagtttttcgaaggcaaatggacctaagattatttagtcggtgaggagagtgagccgtgttggcaggtgctgaaaactgaatgaagtgtgtaggtgctgtaaactataataagtgtatcgctacctctttatcggataagatgacccatatgcgtagataagtctgcccggcgctgtgcataaccatggatgtgtagctacacgtatcttggcggtcgaatgtgcgtcatg

SEQ ID NO: 8389 - DNA, 700 bp, Nannochloropsis_gaditana
ataaaacttcacatggtaaaattcccaaacacaagtcctacgggacctgatcgaaaacgtagcgggaaatattgaaggcaacaatgactagccaagcacccgtcgtgtgggttcgcatctttttgtacgcgagttacaaggaaagtaagtgcaccgccacgccatttcaagctgaagcagagcgcaagatcttttcagctttctggcgcgtgccgtcaaaaacagtgcacaggacccacaagacatgacacctctcccttgcacacacgaaaagacactgctcacgtgcatttccctcctcgcaccgtgtgcaaggccgggccaggaagcctttccacacgaggggagaagcgaaggcaaagctttcgcgtcagagaagagtcaaccgcgttcacggcaaggagggaaatggaaaaaaagacggggcggacgcatatgtcctctcccacacgcctgcgattccacgcacaccatggactcatttgtttgtgacgacattgtcctgcgtggtggggggaacgtggatgtctggtcacggtttgccacattttcgcattcttactgccctcctcaacctcctccctccctccattgccgtctcacagcatgacagatcccacgaatggcgcaacaccgcggacaacgagtggaaggaagcaggatacaacccgaggatatcaggagaaaagcagcgctcatg

SEQ ID NO: 8390 - DNA, 700 bp, Nannochloropsis_gaditana
  misc_feature (1)..(392): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgcttggatcgaaatccgttcaattcggtcgacctgaccgtcgcgctcttaccggacgatcctttgttcgaggagaagcgcgctttcctggcccaggcagaacgacgggagaaggaagcttttccgttgtttgcggacaggtgagagcgagggagggagggagggagggagggagggtggacggggcgttggtggatctctctagtgcttgcatgccggcctctcatcctacagcctcccactctaggtaccccaacgagctctttgaatacctgcgccttgtgtacctgaccaaggaagacatg

SEQ ID NO: 8391 - DNA, 700 bp, Nannochloropsis_gaditana
ggaggtggcccccaatgcgagactcccaaagccaagttaaaggtatccggcaaatgcttgtattggtcaagcacatcttcaatgaacggaggtgagagtttttgggaccgacacgagatacgcggggccggggcctgcttcattttcgaggcgttcactgtgtggttagggaggacggagatggcagtctagactacgataaagaggccagaggggcaggaggtcgacagatcgacctcacagccatgtttgcctgaagaagataaaaacaattggatgcgtaccaagcactcccaacccctctaaaactcgttcgaaagtccttccaaacccgaccgcaacctgaagttgcctcttctcccagtgggcgtcggacataagtccccacattcatggcacaggttgtgtgagccccccgactgactacagggagggaggcaaaagcgtccgttctccgggccgtggaaagccacccttgtgcaggatcacacgggcggaaagtgcataccaatgtgatctttcatgcaccttggtgtcagtgtcaggtcgaatgtggtgccctgtccttttcttgttgtgtttctcccgggcttgtcactaggattttattccctcttcgccccccgcgtgcatctatctaccttctatctgccctcggtttgctgtcgcgatacccaccatttttttcacgctttccaaa

SEQ ID NO: 8392 - DNA, 700 bp, Nannochloropsis_gaditana
tgagaagcctggttcaggtccctatcaagaaaaatcccgcctcgtatgaatggcctttatcgcgtccggcgtgatggttataggctcggaagcgtgagtgtggagatatggtataaaggatactaaggaatgcgactagatgcagacagtcgcattggatagcaactcgatgcctaaaagtaaccaaaaaaatagcggaatgcgagtgaaaacaacaaaaagcagagaagaatgaacgccgcgtcgtcgcctgcaaattcagttctactgccttgaaaaaggtcacgtcatcagtttaatcttaccaggacagatgtatttacataccgtctcgcaaaagacaatgagcatgctcgcttatactccttactggagaaagactgctgcgacagaattgagagccgcgacgacagcaaatgatggacgttaaggtgttgtcccctgtaataattgtattctttcgtcggggcttcgtacatgtgggatgcgcaaacgtttttccctttacgtatgttccaaagtcccctgctggtctccttcccttccctacttccatccgacggccgccgccttgggtgtcgtttccctcccctttcatgacaaccgtgctagcaaagcacgcacctcaccgtcgctaccaaaccacaaaacggcaggtcaagcgggattaaagtctgggcggcgggcgggaagcacgatg

SEQ ID NO: 8393 - DNA, 700 bp, Nannochloropsis_gaditana
tgttgaaaagcaagtaggaaaaagcctaggaagtgtcaattaccttccacctcgagactcacaggcagaggcgccaggtcttgaccaggggaaatatataaaaaaaccacaaggatcacgtttacctcccaacatgtccattgttcactgcacgtctttgaaaagccttataacgataatcaaggagacaaaaccaggcgtgccctctacttgaaactcgggatctctgggcgagcgctgcggcctgcgtgcggcaactgccccgcctttggcggataggcgaagaccaaaaccaaaaactagcgacgccgctcccatcctctttcgtctttctttagttggtagagtgttttccgctctccacgaccgtggaaagaaggccttggtggtctgggacgttgttaacctcctccccaggtggtatgtgtggttatgcctcgtctttccgaagactgcggcctacccgatgatttattgaactcgatgacgagcacaccaccccttcttcgatatctcaaggtgatcagcccgacaggagagtgtacgtatggacgagtcattcactccttcttgtccgtctgtccactccgtcgtccttggaaacgagtgaccagtcgtgtggccccatccggacctccgagttatcccagccacagtgttaaaaacctgtcacgcacatctttgtaggaaaaggaatatg

SEQ ID NO: 8394 - DNA, 700 bp, Nannochloropsis_gaditana
gtatcttttgcgacgcagatggtgcccgcggcgggcaatttcacttttcccgcgaagcagactgtgacggcggacagagagtccctgcgtagtcgccttcgcatgcaaacagtcagcctcagtccatgtcgtgcttggtttattctcgtgggggcgttgcgggggatacaacccggtagcagaaggagaaacgaatttcgtttacaacgtgacgcatggcgtgatggcggactccacttgccctagccatgtctggcgtatgctgcacgcggcgagaccttcgatctcacccgaacggctgcaaccttgttttgaaagttttaagtgtccgcacatcttggcctacgagcgccatttggactgcgttaatggttgtttttgcaattcgtttgttggtttcctcggacaggccatggcgtcgacctcccggccccccgcacggaaacgtcggaatacgcatgcagctgcatcccccggttccacaaggaccgtagcagctcttttctacacagcggcgtgcacctcgatcactgtcgtgtccttttcgctcctacacacgacgcatgcctttgtttatctcccacgaagggaccaccgcttgacaagcactctcccctcccaatgggacctcggccgttgcagcagcaaccacgacggtcggcctggcatgccgaaatggagagggcacacacgggatatg

SEQ ID NO: 8395 - DNA, 700 bp, Nannochloropsis_gaditana
tagaggacgtttgcttgttgtttcacgctcaagcatgctgataattatgaatggtccttccgcagtagaaaaagagtatgcgttcaggtatgagctaaaattagagcccttattacccaccttcgctagcgaagcgaatcttatcaaaatttatcttcattatcatttcgcagcttaccgaagaaagaacatgccatatattaaaaatctgggggatgttcgaaagaattttgaagcctacagcccgtacttctccaatttttcaaggcatttccgaactctcggtgagggtcagtactaggggatcaacactccttcaataaaacgcatttaacacgcatccagacgcattaatcttattatgtgtatattggcattacattacatttaagaaatcgtcctgttccctttttgtcgcgcgagtttgtgtcctttcgaatattaacctcctgctgtcgcgtctcctcgtcatcctttggcgagcttccatctttccccttctgccttgctccttgggctgctttgagtggaccttgggacggtgtgccgaccgatctatacattgaaatactcagggacgagccttgacatcctgaaatgtgatgcgaatgtgccctgcgcctgaacgagaccatttcatcccttccctgttttgtacatcatacagcacctcacctcacatgaggtcgttggagtcatg

SEQ ID NO: 8396 - DNA, 700 bp, Nannochloropsis_gaditana
  misc_feature (287)..(376): n is a, c, g, or t
gagggaggaagttaaggagggaaggagggagggagggccgatatggagggaggaaaagggggccttctcgctcctggctcacgcactgcccttcctctctccctccctcccttcctcctgcgccaggccctctccgacggcctcgaccagccgcctcctcttctccctcgcgaagatgacgagcgtgagagcagccccggcggaggtaaatccaagatcatattctcctcccctgacccctcttcctccctgcctgcttcttccctccttctccctccctttctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcctcgtatccctccatccctcctatccctccttccctcctcttccctccatcctacctgccttccctccttcgcttcccctttccttcggagactcggtagcgggatcgacgcgcaatgtttttttgctacgtacgtggcaggaattctatcacttatcttttccttttcccaccttcccttcctcctcctccctcgtcccctccctctcttcctctctcctcccctcctcccctcaaggaggaagcatctatctccggcgtgtccgagcctcagatcccaagtttggcgaccaagacgagcacacaagtggagcagatg

SEQ ID NO: 8397 - DNA, 700 bp, Nannochloropsis_gaditana; identical to SEQ ID NO: 6257

SEQ ID NO: 8398 - DNA, 700 bp, Nannochloropsis_gaditana
gtccctgtccgcgagaatcgtgcattttggagttcgcgactcacaaatggccttgaggaatgtgtggaaatcaaaaaattcttagaacaattcgaccgtatgagatatattttcccatcggtaccacttaaggaaagaaaaatgggtacaggtatcgcgcgaaacatagctgtcatctgtgggccataaatacgtgcatgcgactccaaaaaacaacttgtcatggacatcaaagggggtaggaggtcgccggcgtcgcggccctcccatccgcgtatcttgctgccttttcctaatgttaaaaaaagaccggtattggtccaatggcctctgaaaatgcgcgtgttttcaccgcagtagggtgtgaatagtgaaaagggaaaaagattcgcgcataatagtgcagcaatcggcattttttcgtggtacatgcccctgtcgtcgcattaaagtgaacaatcgagttctcgcgctcgtcaaaaccggcgcattcccaccgagaactaactggcgcctggtatttctcccacccgcctcccaactaccgccagctaccaaagcaattggtggcgacgggaaattaatgggtgttgaagcgggcatagacgaaaaagcgccgcccgcggcagcacaaaaggaactgcccccgcttggggcgggcgcgggcttgacggacaaagctgaagcacagtcaggtatg

SEQ ID NO: 8399 - DNA, 700 bp, Nannochloropsis_gaditana
agtagatgcacgaagagacgttgcagtttttgataggaggtatctttgttttcggataggagtaaattacagggatgaggttgtatactcggattccgccttgcgtaccatgtccttttacttattgaattttgctttgacatttctctaaggacgacagtgtcataaattcacgtgcgagagagccgatggttagacgtttcagggactgtgctggatgcacttttgggtgaaatttacaagtcgtagggatggagggtcttcatgttagcagccaaagatgggctatgttcatgtttccttaaagcacaaggagtgagagggcgccccccaaatgccccagaggtattagagacacggaataccatccgatttttgttcggaagatgggggattaaagggtttcacaagtatgtgccaacagcgggcaaagcgtcagaacgggttcttcggaccgaggcagggacggggggtaaggctccgtgctgactcgcgtcagcaccatggttgggtcatgtcaaatgtatattcggaggagtctgcaagtttttcatttggacgagttggtggtatcgctacagctcaacaaaaccattgctcgggttcgtttccacaaatttgggtctctgtcgattttggccgctaagctctcaccccccttcccacgtgcctgaccacacagagttacccctcctgcatg

SEQ ID NO: 8400 - DNA, 700 bp, Nannochloropsis_gaditana
agctgggaaagggaagaagaagaagggaaaaaaaaagggggacacctcgcccccggggccggacgcagaccctgtgggcacctccacgagcctcgccgctccaatcgctgccaccgcgcctggagacgacaatgacaacgagaacgggcacgtggggatggccggcagtgggcctgggaagaaaaaaaaggggaagaaagggaaaagcggggggcggcgcccgggcctgaatgggtttgcgaacaccactccttccaccggtgtcgatgacgccgccgtaaccactgccgtgttcttcagcacccccgtggagatgagcccgcctcccctggccagcccgggcctctctttgcaagaaattcgggcccgcgtcgtcgacgacgtgcgccggcggtaccggtacgcttctccgagcctactgggccgggcgggcgccccggtggccaatcctcacgccctgctccgacgcctgtgccaaaagctgggcctccgggtctacgcgcgtgcatacaattttaccggggcggtctcggagcccctgtccttggccgatctggctgaaatccaccccgtcgcgaagcattgcgcccctgcctgcttgctggaagaagcgcaggagctgctggccacggccaaggtcctggctcagacggggaacgtggggccggccttcgagtacgtgagcgaggcgacgagcatg

SEQ ID NO: 8401 - DNA, 700 bp, Nannochloropsis_gaditana; identical to SEQ ID NO: 6591

SEQ ID NO: 8402 - DNA, 700 bp, Nannochloropsis_gaditana; identical to SEQ ID NO: 6592

SEQ ID NO: 8403 - DNA, 700 bp, Nannochloropsis_gaditana
tctgcctagtacttcttgcgtggcagggtttcgcaatggaatccactttttggccttggatggaacaaaaacgccattgataaaattctggataggcggctgggatgtaatttttaattctgtgaaatcatgggtttaacatgagttgaaaagcggagggagacatatacgtactgcagcgtcgagaagatgactctcttgcttattttcgatatccacggctcggtgggcagtggcggcagcagcaaagaagcgtccacggaagcatgtcgtcaatacaggttgtaataaacatgtatttcgcgaggcaaagggaggaagagctttgagcagaatggatcgacgaagcacaggaggagtgatgaaaggcatgtgatggtgtctctgcgtgggtgtaagaggaaaagaggaaaaaagaatccaccaagtcatgagaatcaaaagacgatctacaaaacgacgaaaagtggctgcctgtaatcgcgcacgcgggtctgtgtccggaggagatttgacagaagggtattgaacatatttcacgcaaggaaatcgcccgtggcttgttcttcgggcgatccgagcctcccaccctcgcacaaacgacgcctgtgcaccaccaaaaccatggattttggtgggtgtggttcattcccgtgtcaacattgatcgttcatacctttcctttacgtacttttgccag

SEQ ID NO: 8404 - DNA, 700 bp, Nannochloropsis_gaditana
cacacaatcgaccccagcatattaggcagcattactgtggaagaccgaggcgacacttataccgcgacagccataaagtatctgcaatgaaccagagccttttctcatgtaccatttgaaaaggccatggaccatcctttgaggtagaggctacccgtgaaacctaggagaagaatttttagagagtatcgtaaactagatccaagagatggagtaggcaggaagtaaaaagagagggcgagaaaagataacgacgtgatctttcgcgactgtttgccactccatagatgtcttttctcctttttcttctcacatgcgccatttacgcacaagagcaaggatggtcatatatatagggaaaagcactatttctgctgggaaaacaggtgtgtctggccacattttccagaaaagtgaggaattaaacgcgaaaattgacggcagattgtttttcaagaaaaaaaaagagtgaagcgttgatcgcaaagcagtcattcctataacaacaacggacattgattcaaagatcggacgccgataaatattaaagatcctctcgaacaagatttaaacttttctttaatcttctgcgtgtctcagcggcatcaaaccttcaagactgtatgttctctataacattagagcctttcgacttcttgtatcaaacccagctccctttaacccacaacagtttatcatg

SEQ ID NO: 8405 - DNA, 700 bp, Nannochloropsis_gaditana
gatgatgaacgagaaaaatggtattgaaatttacttggttgggaagaatgcaagatataaatgttcaaaaagaaaacaatgcctcctggggttttgaaccggcgttcaacggcacctaagcactaccaacggccaattcgccgttactttactatccttaccttttggctctttccatgtgatgacgggtcggtccatcaatttcaatgtcttatcactcttcaaagtcgtccttcttaccattttatgatcgcattttgtaggttttttaacagcgaccctttttgttaaggaagtcaaccacccacgtggacggatatcttatactttacatgaatgcttttcgaatcttacgggaccactccacttgtttcatagccacctagtgaaagacaggcacacatacgaagacatctactctgacaagtggaggtgtaacgcggagagtgaggaaggccttgtcacattagcgctgacgaaggacatgtcagctatgcggaactgtcatttccatctcgcactccttcttttgggtggtctccaatttgcaccggcagaaattatcaaagcatcagtctatggtggaaacagctctaatctagagactttaggtgttgaaggcctacccacgaatatggtggtcgatagaaaaggttacacatacctgctgggagaatactcgtcgtataaaccaaacatg

SEQ ID NO: 8406 - DNA, 700 bp, Nannochloropsis_gaditana
ggcaagcctgagccctctctctccctgcccctctccctcatcggctctcaccagcagacgaggatcgtctacattatccgccgctgccatccgcgtcactgttgacttgacttctgctctgatccccacctacgaagaccgagaaccaatggggcaggtggttggattaaaataccaggggcaggctcgaattcatgaacggatcgatctcccctctctcatggtctgggtaccttagtcatagcaggcccgacgaaggcgttgctgcttgcgagtcctgcaacaagaagaaatgtcttcaacatcttgaagaaaaaaatctgttgttttgcagaaagggtcgaggaaagaagaaaagaagggagggtaagccagaattctagtactactagtaggagaggtggatcggggtgctgtcgccatattattccagtcccgggggtgtaactgaaggacggaaatagaaaagcacaagaaaagacgctccagcgtacaaattgagacctctactctcgcatatcagtggtggtgtggaacacttgcacctaccagcgccggtaggaaaggaaaattgaagggatggaggagcggctgcgatgacgccggggccttgggaggggggggggaggttaaaatgtgggaaaggtgataccaccttccgtcccacacacacatatggccgtgcctccgcgcaatcatg

SEQ ID NO: 8407 - DNA, 700 bp, Nannochloropsis_gaditana
  misc_feature (686)..(695): n is a, c, g, or t
ggatgtgcgtttgccgtccggggaggttagccggatgacaaggtcgacgcgttacaagaagcattgggaactgcctcccaggaaaagtgcaaaccaatcagaaaacgcctttgtcgttgtcacattcccctgcttgttgcatatatgcgggcgctgacgtctgttttttccataatgggaatgtcgagctccacagcactgacactcgctaaggatctacagcgatcgacgtgtactacgtgaagcaatttggtgtccaaacacccgacgcacaagtctttggaaagcgtgtcgaaggacatcaggctgtgcgtttgagtccttggaagcaggtggtagtaagcaggcgcgctggcgcgcttcaatccgccttgatggtccgctatgttatacacacgctttcctcccccttcagtccaataaatgatccttaaatatttgtttgtaaattggggacggggggggtcatcggctcagggagcttgcatagtgggaatgacatgaagttagaaacaccagagtttcctgaagtctaaggcgtgaaggccgcgcatgtaggtatttgtgtcgccccggccatttgttctttcgtgtctttccaatacgcttcgcacttccggccttaaatcccgcatccacagctcggaatgtccttgatgctccatccctggcgtcgatggaggcgnnnnnnnnnncctcc

SEQ ID NO: 8408 - DNA, 700 bp, Nannochloropsis_gaditana
cctttgaatgctcagcatgtgttggcagccaataaattcgcgggtactttccgatggagataggaagtctacgtgccagtttcgtggatgccttttggaacggaggtcaacagctctcgcgtgcatataaacgttgattgctttaaaacatgctgagccagatatctagatgtaagtcccaactaggcatgaataggatgtgtttttgaacacttcacggtaaagtaagaacaattagcgctgtggacacgcttaacctcccctccgatctgcacttcagtggcggaattcctttgacgcgtccatgcaccccagtcgtactgcgcattgctcctaagcttaaacaaccccacatttgatgcatcctacgagcggaacggtgccaaagctgttgtccctgtctccaaggacagggggctcgctggaaaacgaagggtgcaagtcagcgacgcgctccagttctctcccgccctccctcgtactacgcccttcattgaccccgcctgtgcacgcactgaccgcaacagctcccacatatgcgagagttccatggcctcatgacatagagtgacacctcagctatcctggtttcatttctttacatcggtccttctctcctgggcaggttttctctccgcagcctggggggcaagttgcggccgttttccttcatattgaaccttcctctcaatcctgcatg

SEQ ID NO: 8409 - DNA, 700 bp, Nannochloropsis_gaditana
  misc_feature (1)..(608): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccccccctcccctccctcccagaatgggcgccctgcctggcctgccccgagggggaggccatctacgaccaagcctggtacccgaggatg

SEQ ID NO: 8410 - DNA, 700 bp, Nannochloropsis_gaditana
cccgaagcatgctgattctaatcctttgtattctgtaggagagtgttcatgcgagagtcctggcgcacgcagcatatttaccattttcctggctaggacattttggctcccataagcgaattctccaaccatgtggagcttaacctctcggatctgtgtacaacaaatcatagcaatatttcatcgtagacctcattatcgtcagaaacagaaggatttccttgcgcaatgtgtgtgtcgtgaacgtgcgtcgaaaagtctgcccggaggtttaatgctcccccttggaaattctcagggcggccacgtagcctagagagtgaggactcatcattcacatcgcgatcaagggtcaacaatcaattccaaaatttggccacttgatagtatgaagcactgtggcttggcttgcaatggtatcgtaaaagccaagcgtgaagaacttgcgagtcgccctaattgccgttatgggccagtatcttccgagcgcggcttccccctctctgacgtctggttccaaattgtacagcttctttgtaccttctgtcgattaatttagcagttactaatctgacaaatctaatattttccgacagctggaaaaaatatgcggcgtggattacattccaatagacacctcttcagcttcaaacttcccctgagccccgtgttagcttcctcctcgccaggaaagactatg

SEQ ID NO: 8411 - DNA, 700 bp, Nannochloropsis_gaditana
accgcgaaaatgtcgactgtccagaaccaggttgcccaacaatagcaaccatgggtggtacatgcgttccgctagcatgagacgcctctgacttggttgcggcgacaattggtgccaggcaaggtggcacgtgcgtgtctcgaggggccgataatggtgtggagggagagggaactaaaaatgccgtgcagggcgaggtaacaagcccacccagtgtccaaaggctccatggccaatgacatcttcttattcgtgatgagggatgcatgctgttgtcggtaggggctgaaaggaggacaagttaaactgcaggttgctgttgctgttgccctttccgggcctggggctacgcgacgttatggacgggcggaagtgagtttgggtcgaccgtgctgtatttttttttgtgtgcacaagcagacggccacgcttttagtggccacatcagtattatgtgcccataagggtgttcttagcatgtcatcgcgaagtgtacggtaaagcggtggcatggtcataattaagttagacaggcgccttgcttgcaacgggcttcgacctggtatcccatatacagcgtatttcgtctaaactctaccacggacgtctcacactggacagagtaatgccgtcgttgcctgcattgtccccttcaacatttctccaccggtccttttacttcctttttgttgccaccatg

SEQ ID NO: 8412 - DNA, 700 bp, Nannochloropsis_gaditana
ttcacaatccggtccgatccatgagctgaaatttttgtaggccccgaaatacaccattttgtacattgtgctctttatgtctttcaagcacgttgctgacattctaactattttcactacgctaattgtttcaagaccacaaaaccaaactttaatgggtaatttaaccacccgcttgccttccccaaaaacaaaatttagctgaaccggtcaaaattaaattaatacaagtaatgaagaaaaaaatgaacaagggaagggccttgttggacaagggcacggggacgccttaacggtcggacagtaacggatttctggaaatccgttacgcgtcacccttcaagcttccttgcttctttgaatttcgagaggtgatgctgagacgctgcggcatcaatacgcttagaacagaaaagtatgaaatcaccatttgaacgcgttgtgctgctgcttttatggaacatctcgcctatgaccatgagatttgaaacttgcgcgccctcggaggagcattcgtatttagatgggcgcccctgctcccatgggaagacctcaccatgaaagacatgataaatcatgaaatgataacctgacttggtcgatcatttttgtacgtgttgttagggatgtccgacacaagtacaacgaaccccgagcataatctaggtcaattcttatgtgacgccgctaatgcatgatg

SEQ ID NO: 8413 - DNA, 700 bp, Nannochloropsis_gaditana
gctggttgctgttgccccgcctcctggtctcgcctttttccagccagcgggtttgatatcatcaagactgcaatcgatagcaccaccaccgcccacatctcctccaaatgcctgccctggaacaaaaacatcctatttcttgccctctttcccttccttaactgtgtttggggccatcaaggggagggctaccagaacctccctgtatgctgcagcgcctgcctcacccgcgtcctcgagcagcggcaacgcgggaagggacgaggacgaggaaggcagttttccggacgaaagcgatagccccacgccgtcctcccccgacacgtggcgaagcaatggaggggaagccttgccaccgaccaagcacaccacgcaaatcgacttgacaggtatccccggacaggtcatgggcagcatcttcaagctgaaagtgacctcctgcccgcccttgttccgcagaccttggagcaggcagcccacgtccacgtccttctccaccgcctgggccttcgatgtgaaggagaagctcctcttaaccaacagccattgcgtggcagacgccgtggttatcaacgtgaaaaaaccgggcaatgccgacttgttcaaagcggaagtgctggggaagagcgaccattccgacctggccctcattcgggttccggatgaggtgttttgggagggggtggaagcgattcggatg

SEQ ID NO: 8414 - DNA, 700 bp, Nannochloropsis_gaditana
  misc_feature (1)..(373): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccactccctccctccctccctccctccgccccacagattttcactacccagctcgcccgcacaaccgcgtctgcgaccattacaggctgagtgtcaaggcgggggagacggtggcgctctgtggaccgagcggctcaggcaaaagcactgccatctccctcctccttcggttcttcgacccggtcgccggctccatcaccttggacgggcacgacctccgctctctgaacctgaaattcctccgcgactgcatcggctacgtgggccaagagcctggtgggtactcctctgaggtctttttgctgacggtggacggattccgatg

SEQ ID NO: 8415 - DNA, 700 bp, Nannochloropsis_gaditana
acttctttctctttactgggcgacaaaccccctcactgtacgagcagtctacgatgtttgaaagaataaggttgctgcttaacgacacatgtgatgtcgcaacgagcggatgccaccggctttacacctttcttcaaaccttcttcaacagatacaggcaaaatatgatattccccttgtactgtgcgaggtattcggaggccttacagaatatttgggacctaaggggcggggcaatggaatcaaaaacctgctgcacgttgtggcgctggccagaatttttgaaaaaacgttaggagggagtgccccccccaagaaaaagaggcagcgcagccacgaggacattggccggggtgaagtgcactgattattcctgtacgcctctcctcccatgatgacttgccagtcatgtggagaagtgtgggttttttgaaatcaaatgaaaatagtgctaccctttgacttggttcctcccacctgtaccagatacgcctgttggagccccatcttccactgccccctccaaacacttcatacgaaacaggtatagacggacgcaacctactgtttataacccctggttcctcctctaatggacctaggtggtcattcatcgccctcacaatcctgtgagcgtgatgcggcgccggagagactatcaaacggggaggttgcgcccccatcccctttaccgccaatg

SEQ ID NO: 8416 - DNA, 700 bp, Nannochloropsis_gaditana
gacaaatctatgccgcgggactgcacacgaataaccgagggaaaatgatacggaaggcatcttaaaatcaacacacgcgtcgcaaaaagccgatgagatgtacagcctggcaaaaggaatgaaaatcacgtcctcaaacccacatgttctttccaaaagagacgtacgtgcgacgctctaggcaaatggtgtaaggaggaaccctggggaggaggctaagagacccctggcccgtgagccgcatttacacacaaataacaaggaaataccggacattcaacgacccatgacacacgatatgcaacgcattgacgttcattacccttcataaacgcgcaaggtccggaaatgcggcaaaacctggcatttttttcatcaggtagctcgaatctgtctcgctcctcgctgcgtgcatgtcgggagcgactacagccctttcctcaaaggaaaaaaaaggcgagaagttggcgtccctggtggcccccaaagccgaaagaggcgtctttgagacatttcatacatcctcatgcatgactttcgccgccatttgtggaattattgacaggggaggcattgacaacgggaaaggaggagaaggaccgcgggttgtgagggaacgggctacggggccaccgggaagctgtctttgcccaaggagcaggaaagcgaccgggaacacaggcagaccgcggacagcatg

SEQ ID NO: 8417 - DNA, 700 bp, Nannochloropsis_gaditana
gagcgtcgcggcgtagagggaagggtcggttcgtttgagggcctccaggtcgatagcatcgtggtaagtcaggttgaaaaatacattgcaagcgcccacagcgggcgcgagggggggcgtttccccctccctccgaggccggagggccgcgctcagggtggaggaggaggaggagggagagggaaggaagggcgggcgctgtttatagccaaagacgaggtcgatccagtggtggagatgagcgctgacaaactcactttccaacgcctcacgatgcatgcgcacaaaatcatccacactcccatgggcccatggcggaagttccacgtccccgacttcgtccccactttgggtccggcccaatgagacccgattcacgttcgacaagaattcggggaggcaaaagaattccggaatgagctccttcacgtcgttggggttggtcacacaaccctggtaagcggtgcggagggagcggaactgccggtcgggcaaatcgaaatgtcccgagtgaaattcccgatgtagggaagtgaaaggttccaggcggaggagataccagaggacaaacgctgcattcgagtaatgggatccgtggtggaaaggagggagggaagacccactatcacccgcgaagcacgcctctccgtatccctcccgaagggccgcgtaacggtcttggagccgttgacgggccgtt

SEQ ID NO: 8418 - DNA, 700 bp, Nannochloropsis_gaditana
gtagtttgggctttttgggtgtgtgggcaggatgtgacggcgcgcgtaatgcacaaaaatgtgcggcgagaatgggccacacaccagcagaagtaagcatatgggaatgaaatatgatactttcatcgaagagtcacacttgaccgctacagagttcatatcgtcttagccttctgcgtgttcagctgaaaatcctaaattgtacccgcaatgggttaaatattgagcaaactgtctcaagtcaccattcccaatcttgtcatcctctgttcccggatcatgatcgacacatgcgaatgtcaactccacaggcgaggcgcccggtggctggcattgatgttcagcacccattcccgattttgcatagaaaatacatatcctgatggaaactaaagagcgcttatttaaactcgttattgtacgtggttgcgacttgacgtctgcatttctttgtcttttggcctcgatgggaagcaaggggggaggaggttaatgctccgctccgcttgagcacaggggacaaggagagggttctcaacacaaaacaatatgtttagtgacagaattgatatctctctctggtagtctcgaagtaaggcgctcgcctctgtcatatcaggggagaccatgacttttagtttccgtgtacatacacaggctgaattcctatgaccgacaaacagcaagaacaagagtgaca

SEQ ID NO: 8419 - DNA, 700 bp, Nannochloropsis_gaditana
ttcgatccgacaaagtctcaggtttctatggaagcccagctcaattggtgcgtatttaagtgtgtgaaggtttgcttgccttttcattattttcccctttgtccgggcacacagcgccctcttacttcgacagcgtgatgtccactccttctttcatgttcaacaattactgtccatatctccataaaatatttcacatatccttcactgaagattggcattctcttcccttctttcctaagtcataaatctcgcttcaccttctctccctttttaattttgccgcgatactttcctccttcattctggataccaggcttcgttctcctatcacgggagacctgcaagagattccaggcattggtatgtactttcatccgaacgaaggggtctacttctttcaacttttcgatcttctctatctttctcctactgcccttttacatggccttccatccttcgtccttctttaatgatccgctttcaaggacccaaaaacgctcagcatcttcaagacaagcacatccacacgacccatcagctcattggcgaggtatgaaggccgcttgttctgctttctttcttccctctgtttcatgtcgttttcgccttgtcttttttcacatgggcccatccaagctcgcttcccctcccgcttcttttgcctcctcctttcctttttccacagtacatgaagatg

SEQ ID NO: 8420 - DNA, 700 bp, Nannochloropsis_gaditana
cgtgagtggtcgccaccctcaaacatgcacatccatggacgtgtcgaggcactgtgcgcctattaagtgccaaatattacggcacaaacgaagcgcagggcggtgcatgcgtatgaagaagggcgtgtgcttccggctcccggggaggtatcacctactcctccagccccttcaaaggccttacggcccgtctactgataaaccatcgacaagtctttcatgacgtgcgtgatgcgttgtgaatgtcacgagagatttccttgatgcaagcccttccagtctgattgaccacctaatggctgcgttgtcgcaggatctctttccttggcgaggcattagatcgtcgctcctggcggtgcatgctcccatggtttcgggaaaatccgaatagcacaggatgtgttttatcgccaccactcaacatcacaacaagtaggaacgtggaagcgtgaccggggaggtaaggggtaattataacaagagaagtgatcgatttgagtcctcatcggatggctaccactcagttcttgcacctttggcagcttccaagccagattacttaggttttagaattacatccgcctcctctcacggcgtaatgttacgttttcatacctccaacacgtcaggcaggaggtgggaaaggccaagggcaagcgcacggccagttttgccaaacaaccatacacattgatatatg

SEQ ID NO: 8421 - DNA, 700 bp, Nannochloropsis_gaditana
tccctccctccctccttcccctcaatggcgggcaccatgacttcccttgctctcttctatcaccgtcgtggaaggtccgtcgatatcgtccacgaatgtcacagagactggattcgcgtggtgatggccatcgcctggagtcgggagggaagtaatgccgggaaaggatggaaaggggtatgaaagaagggaggaggtgtacgtgcacggggggaaacgcgcgcttgctcccgtagtaaccctccaccagctctgactcctcccactgagcccacgaaagctcgacttgaccctcgtgcaaagcttgttcgtaccatttattgccttgttcgcccagtccactgccacgagaccgagaaaaatcccgcaggccaaggtgaaattagggatgggtcgtttgaagcccgaagccagcatggggtgattacgccacgcgtcctgggagcggagggagaacccaggcatgctctcgaatgcgtctgtgcacgggattggaccggttgggtgggtgggtgcatgaatgaatcagcggaggacggcaagatgggtgagggtaaacagacagagagcggcaccggatcagcttctcgcccgcggcggtcacagggaccccaaaaccattttttaagaaaagacacaaaactggaacccactgccttcccatggcgacactccgctaccatacacgcacgcaatcatg

SEQ ID NO: 8422 - DNA, 700 bp, Nannochloropsis_gaditana
agaaaaacggccatgcgaacagtgtggatgtggttgccaaagccctgatagattggcgtgtggagcaagtctatcccgcggcggaaggggcggaaggggtgctggaagggggagagggagggagggaaggagagggggcaggacaagtgatctacgtggatgttcacggccaagtctttgcctccaaggcggcggcggtggaggcgttgttgtcgcgggtcgtccaggaagaggagcaccggaagatgaaggcccgaaagcgcggcgagatgcggcggaagcaggaggcaaccccgggtcgggacggcagcatgtccttgtcagcagggccggagccatcgcctgccaaggtacccggagtgcagagtccatcgtcccctgcaacgtccgccctgcccttgtccagcacggccaaagccgtaaagggcccggcatcgcgtccctccctccctcctctcccttccatgaatccctccgttttggagacgctggggggcacgcttccccccctgcccgcccacagcaatacctccagcacctcctcgatcacgggggaggccggggcctaccgacccactccactcgaagccgacgcggcggacggaaacaagggggaggagttaagggggggcggcggcagggaagacgacgaaggggaggaagggagtaggggggagagaggaatggtagattccacatg

SEQ ID NO: 8423 - DNA, 700 bp, Nannochloropsis_gaditana
  misc_feature (579)..(588): n is a, c, g, or t
cgtgcacgcatatgtccgtctattcatgtatgcaaggagcgaggtcatgagtgtcgggagatttatgtgtttcttaatacacgaccttggctcattcgaggcaaaagtcatataagcgcatatttatagtcaatcgcccacgatccagggcatctgcttttttatgatcttacataaacatctacccttacatctctcgcagagctcatcagagttcatcttgaattgccttgcacgcctgactcctccaatgacgacaagtgaggagatctctctggaatattaccggatttgctgcgcactgctacatcgctggtatttcgttgcacacaacaaccgaaatgatatcagtgaagcctgttctaaaagtggagcatcttatgaagaactgcgatccattctgaaataccttcgggctcactatgtgggtggttttttgactgcgcgcaagctgggacaggtttctgatgatctgttcgcctactatctttccctgaagcagcaaaggcgccgtcgtactgctacaaaaaaagaccacacgaatggtggtgtagatctttctttcacccctttgtctannnnnnnnnnggggggggtaaactggggaggaaggggtaaagtcaaaatggagggggagggaggggacggagcggtgagaagcgcagaggaagacgcgacgttgaaagcggcgagggagatg

SEQ ID NO: 8424 - DNA, 700 bp, Nannochloropsis_gaditana
actagggggcacattgtaataggtctgcggtagctgcttcgaaacggctcgtctaacggctcgtctaacggctcaggcccgagcgtcgtcaatgtttcgaaatctgcagctggagcccaactcaaaggtaaggagtcggaaacagcttttagtacgccctttactttcaatctagggtttataaaacgctcaaggggaaagtcatatccatcgtgcatcgagcagattttatttgtatttgatcaaagtggagcttgacgcagcaacgatgagatgatatggaagttggtatgtcgaaaaaatcccgtacgcaacaaaaatgaatacggccatgggaaatgataataatttcaattgtgaaacatcgagtaaagatgtttggttggtggttgatggttgaatgttcatcgtgtgcataaattttggtaaaaatgaaggtgacatctcctttacagaagaggccgcttacagactatatctcggtatttcacctctccgaaaatgtgcaataaagttgcctgctttcataagaaattcattacattgctattatttgtctccagcggtaagtacccacgcacccatgagatacgcacatcgtattcgaccctggtttcgccgtgctggctgatttctgacttattttagtgctccttttaggtgacgctatgaaaaaagagagaatccatgcgcatgcatg

SEQ ID NO: 8425 - DNA, 700 bp, Nannochloropsis_gaditana; identical to SEQ ID NO: 6837

SEQ ID NO: 8426 - DNA, 700 bp, Nannochloropsis_gaditana
cataaaccccccattgctcgaaacccaccagaatgcctaaaaaggaaaaagcaggctcacgagcgatagtaggcgtcgaaaaacttcattcatttaagcatgccgatggtttttggggactgtccaccggcccaacacttgcctgtgtccttgtgaggtttcatatgaacgagaagctcgctagtctctgatcgactatgttctttccaagcttcaagctgacgccaagagaagcgccgctacactggaaggcgtgctccataccctacctttggaccatctgttgctcattggttatgtgcacgaggcgtcaagtgcagtgtccgcacgtgcaagcggcctttccttttttaaaagggaataaaatcaaagctgcaggttagagcgggttgagacatctgtctcggacctgacaccccctggcatttcccacgaatatgaaaccacaagtccacaaaaacatgtacaacaatatgtatgataccaggataagcctacaagctatgcggactgtatagattgggcccagtccgtttacttgtcgtaaaagttgacaaagagctcgccttcctcccctctggtcatcttcaagctactacacaataatatcaaacctcgttgtcctccctaccctcacgacctggtgcactctcctcacaggacaaattctcaccatttttgtcccacaatagcaagaatg

SEQ ID NO: 8427 - DNA, 700 bp, Nannochloropsis_gaditana
  misc_feature (1)..(358): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagaagaagaagaggaggaggaggaggaggaggaggagggaggggaagcggtggcaggaagagaagcgcaagagactttgcaacgtgaaagggaagaggaagccgcggcagctgtggtggcaatgatgagaatggaggaagggaaggaggaagggaaggaggaaaggaaggagaaaaggagggaggaagagaagaagggaggggaagaggaagtaaaggtaggagggaaggaggaagagaaagaggaagggaagaaggaagggaaggaggaaggggaggaggaagcgaaggaacctggaaggaaggagggaggaaatcagggcgaggcaaaagacgggatg

SEQ ID NO: 8428 - DNA, 700 bp, Nannochloropsis_gaditana
  misc_feature (460)..(469): n is a, c, g, or t
actcgcttccgtacgctcctcactgcctctcctccactcaccacgacgacgacggaacttggtctggtaccgcttaaaatattgcttattcttaagaaccttgacgaaaggctgtattttttaaaggacaagaaagaaataaaacacaggcatcagatcgatgagtgtggctatgatgaagcggtggaaaactaggtgctcgagagagcagttggacttaccattgttgcgaagttcacagactatagatttacgcctgtatgtatcgcaaatgatataagagacgtaagcagagaaagttgccgctgacgggtcagatacaatgtgcatttggctgagcatgtgctcgtaagcggtaacgagaaggaatgtagggcgacggaatcccacagtggcagcctcgcgcgttatctgccattcatagccaacaagccacaccggaacagaatgcatcacggtnnnnnnnnnngagggagggagggcaggcgggctgggggatacgagaacttgttccttggaaggagagggtaggcccgtggtgaagaagtcacggtgaaaggttgctttttgccctgattccacacgcggtgtattagacttaatactgcgatggcttccatatccgttccacgaacttaaatcaccaaacctagttggttacgccacgtacctcctgcctccacaatcacaggaccgaatg

SEQ ID NO: 8429 - DNA, 700 bp, Nannochloropsis_gaditana
  misc_feature (1)..(525): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctttcctcctctccgccccttcttccctgcccctcgcgtctttcgtcccgtcgtctgcccgagtccttcatctttctccccccttccccccctcctccctccctccctgtctgggcagatctcgcaagccttattgggttcgaagctcgacgtgctcaccctggatgggatg

SEQ ID NO: 8430 - DNA, 700 bp, Nannochloropsis_gaditana
aagaagcatgggcttggcgaagaagcggcgaggtaaagcatgataaaggggacagagaggcacgtttccaggcaggcattcgaagagactcaagttgagcgggtcgataggtaagagggtgggagaaacacgaagcttttgattgagaggaaaggagtaaaagcccaggaaagtgtcagagtgtctcgacgtggatcgatgcctcctcgcgcacgtcgggggctacgactgacgaccaccctggctgagactcacgttgtatgtgacacagcagtcgaagtagtctgagaaatattgtcatgtcgtaaccaatagatagaacgaggcagcagggtggtagtgacggccatatttattaaaaatcacaagctgccattaagaggacagaatgctggaatgaagcggcccagcgtgtactgccctgtagccccaataggcgacaaaataatgcgcctaagccatgacggccctcgtctaagccacacggtgcaggaatcgggcatagtagcatgctttcggatcacgcggtgttgtgaggactccgctctgctgagctctgattttccttggcatgctcactctcacgttgtcgcatgatacgcctcttatctattctctctcttcaaaccctcccagagccatgctagtgtcaaggatccttctcccggtgataacactggcgtgcagcgccgcagcgatg

SEQ ID NO: 8431 - DNA, 700 bp, Nannochloropsis_gaditana
cagcggtctagctcctgctcttccagcttctgctgagacaatcctcctccccccacgtccatgccaccgccaccttcagcacagctctcgtagttacggaaggacatttgcagcacgctgctgccgggctgaggggaggcggacgacgacatgggagggtcctcttcggggttttggttggacccaggggctcgatctcgctcgccttcactgccgccgctggaggaggaattggtctgtacggtgccagtgatatgattgtattggaacgccacgttgccggtgatgatattggccccggagccgtagattacttccttgggctccaaatcccgcgcccaagatctcccgcgatacggagacaaacactctcctccttcacctcgctgaaaggatggtacgtcaaactcatcccagtcccacaaaaagccaccaagacggttctattcgggtgtgtgacgcatgaatttatttttagaaaatgtttcggggccgtagttgagggcttatttaggccagggctcagtttcttcgtggagctgagggaaagccccgacaggcacagtgacgcccgtgtcccaataaaacctcatgaaaaagactttttccggccgcccatatcgcacaggctactcctgttgccccttctccacctctttccgacgtggtcacaggcgcgccttacatatttcacctcatg

SEQ ID NO: 8432 - DNA, 700 bp, Nannochloropsis_gaditana
ctttctctttgggaagttgacctttggtgtcacacaaagagtccaaacgccctgatttcgcaaggacaccctgtggttcaaatattcacgtgcgctctttatcaaaccattgtgtttcactgatgcaaccctcacaaaaagggcacctttttttggttttttccgaggtttcaggagaggacagcgtccctccctccttcctcaggactttctgacgcttcctccgcttgcttgccttcaagtcaaagcacctaaaaacccgcgaaggaacgtaccaagtcattgctccttgtctgtgtcggtgtaaaaaggcaagaacttgtgtgaatactgccttgaagtgggcatgaatgttttttgaaggcgaaacggggaatacgagacaggcagtgaaaagcctcccgatcgaagcggcacggccgcggccatgctcctttttcccccttgtaaaacgcgtcgtcactcccttttatgttctttatttactccttacacattttgggtgtattatggaccagacatattttttgtgcccatcgtaccgcaaatttggccctttacaggcgcttgacctctctacctccgcttctcctgcatcgtatcatttggtttcctcttcttcggcgccacctttaattccatttgcggccgcccccaccgtacgtcaagcgaacgtggagggataggaagcagcttaatg

SEQ ID NO: 8433 - DNA, 700 bp, Nannochloropsis_gaditana
ttgtattgtccgcacacctgcaagcgtcatcaaaggcgctcatacgcgctactagggaaaataactgtggtcgacgcaccttgaaagatcaagctaaaatcagttgaaaagatgtaggatgcttaaaccctgctttttttccccttcttgaggtgccatggaaatcaaattgaagggatataagtggcatttgcattactccatgaaaggtcttcaagtggaccacttcctgtatctgccctttagtacaaggagaagtaaaactcatcaagtctgttgcctcacctcaatgtcatacaggagtcgtgcaccacgccggacgaatagagtgaacattcaacataagtgcacaaatttgatcatttcatggatgccttcccatcgtggaaaatgacaggacatggcatgcaatagcacacgcataaggtcaagaggcagcctgagtatattcattcgtatgatggaaacacacacacccgtaagccgtcaaggttgacaactctccacctttctcgggaagtttacctcggtaagcataaagaaagaggtcattttcctccacatccaactgtcgttaagaattgcctatgtcttgttcgtcgtcggactcaacgtgctgccgtccatcccggtccactgggtctctgtcaaaaccgcacgccgactctcccctcccctccgcccatccgcacggctcctc

SEQ ID NO: 8434 - DNA, 700 bp, Nannochloropsis_gaditana
gggttagggtcggtattagggtcggtattagggtcgatgttagggttagggttagggctagggttaggctagggttatgcctagggtcaggctagtattagagtgtccttcatttccaagtccttccatcttcccattccagatggtggcgtggttttccaacacctcagacgtctatgtctccatctatgagagcaactcccgggacggcaccgccggggcgctcgaggccttggacgaggcgctccaggcgagaaggcgggagagggagggaaggaaggcatgcgggaggaaaatgaagctgtgtagaccagcccgggccgggcaggaccccggaatgatgaggactcaactatttaccctccaccgctccctcccttcctcccaggcccggggcattcctcacaccgtggtcacgggcgggaaggaaccctggacgcggggtgacgaccggatcactttccttgcccggatgcgaaacaaggccctggatccgcttttctctccgtgagtccaattccttttttcccctttttctccctccatcgagaggcttcgtcgtcattagaaaggctgaccctttttcctttcttccctccctccctccctccctcccgctacccgtcattcccctttccactccggcgcagcgcacagcaaggccggcctcccttccacaaaatagtcttcatcaacgatg

SEQ ID NO: 8435 - DNA, 700 bp, Nannochloropsis_gaditana; identical to SEQ ID NO: 5371

SEQ ID NO: 8436 - DNA, 700 bp, Nannochloropsis_gaditana; identical to SEQ ID NO: 5374

SEQ ID NO: 8437 - DNA, 115 bp, Nannochloropsis_gaditana
ggggggtaagaaaaggaaggggctgggcagccccggggggaaaggggggggggagacgaagggagaggggcccgcctgggagtcggactgcgcccgcttcctggacaaggtgatg

SEQ ID NO: 8438 - DNA, 700 bp, Nannochloropsis_gaditana; identical to SEQ ID NO: 5376

SEQ ID NO: 8439 - DNA, 700 bp, Nannochloropsis_gaditana; identical to SEQ ID NO: 5378

SEQ ID NO: 8440 - DNA, 700 bp, Nannochloropsis_gaditana; identical to SEQ ID NO: 5380

SEQ ID NO: 8441 - DNA, 700 bp, Nannochloropsis_gaditana
atgtctaaagactactcctgcgatgtcgtaatgttatgcgacccatctgggttgtcgcgctttgaggaagaatcgaggcagattcacgcgtgcacggacaggacaggagaacgtcaggtttacgccgcagtcgtcggccgcgacgccacaaatgtaccacgatacccaaaagcgagcgaatctccacggtgcctggtccatggtaccacaattccttcccaaatctttcccccgtccgtccctcccccgatgccatatccggggcgaaattgtgcgcaagccatcgcggttcaagcatgccctcaaatattcgtaacggttgggccctgacgccgcattgggcccctccggatttaggtcctggctcccaggactcagacacgcggactgtccaccgagggcgacgtgggcatggtctgcttgtggtggtggtcgtgccgggggagtatgggcagaatgtgtccgtggagtcccgtgaccatatctgagtctatccagggacgtgggcctgggtttcgtagtatccctcgcgcgccggatttttgccctcgtcaagccctggctttttgcctcacccaaccctcgtcgcacttctccctctggccagcagcgccttgctgccataatcggcggacaaactatacggtttaatcatttcaacgctggaacaggaccgtgattgttgcgctctgcggccatg

SEQ ID NO: 8442 - DNA, 700 bp, Nannochloropsis_gaditana
tcttcgattcatcaggatcggccggaaaggggaagatggccctcatttttcaacgcaaaaggacgagaccaagagggcaccgcaacgcacctccctgtctccctacgagattgttgccacaaaactcgggcgctttgaccgacaattgcaggcgttgcaggtagacgccgagggggaggtgagcacatgcacgacttccatcaaagagctcttactggacacccaaatgcacgtcagagacctgatcgcgctctctcccgaggcccttcgtaagcggggcggtcgcctgactccctgtatcctcccccggaaagacgtgatcgtcttcgtgatgcatcccttgcgcctcgtgatttccaagaacagttgtctggccttcgatcccggggaccccaccgttcagtctgtcatcgccgacatttcttccgccatcaagatccagcagctggagagggctcacctggccaagtcggggaatgggtcggtcctagagccgtacgccatttcctacgagctggtggtgctggagcaggccttacgcagcttctgcaaccagttctcccgcatcaaggagctcctgggcttgatcgtcgagacctcattgaaagccctggtcgactcacaaggatccgaccaggaagagcagctgtacaggctcgtgcccctcaaggacgggttggcggtggcgcaacacaacatg

SEQ ID NO: 8443 - DNA, 700 bp, Nannochloropsis_gaditana
aatcaacgcgaaccttgggcccagcagcagttcgatgacatgggattatggcgtgaactccacgaccctccatgccggccttctctagtcaccttccttccctccctcctcatcacgatacggtaccatggacactcctccgcccttgccgagattgtcccgcaaaatgcagattttctgctgccaatcctggtcctccctgatcagaaactcgagctccacctccttgaaagctgctacgtacgccacccgcacatacccgattctgaatatttcaagggaaaatgcgacgagaagggagatgaataccaaatcagtacgctcgaaaaggtaagttcagtgcgccaaaaggatgagatcagggcgtccatcccacgtaggcgcttgccgaagatagttgtgctcgactctcaagcaacttaagacaatacatgctggtgcctgcagccacgcgcccacttccctttcctttagggcccacctttcgaacatgcgcaggctcgccacgttgctgtcggagattttgcaataaaagcgccggacccccagtgcctctatggcgtactgcatcatcgcttccaccccctccatcccaagccccctccctctccttgtgggctcagcaatcataatttcgatttccgccacgcccatatcaccatctggatcattgaaaaagaggttcacgtcgccgaccatg

SEQ ID NO: 8444 - DNA, 700 bp, Nannochloropsis_gaditana
cttcaacgctgatcttgcgccgcctcagttacacccccagaggctggcacaccgtgccgtagaaagcagtcgaggatcgataaatacgatacacaagaggctcatattgacatgtccagagtgtatggtgtcgtgcgatggaaattattgttggtttcgggggaaccccccttagttcgacctcccccgcgggtcgtgttcttcctgcctccatgtccacaacgctcagccttttcattatgtattgcacaagccaagacagcaatataatggcaagatgtctcaaaaggcagtttcctcattttgggctctaatgcggcgctctttcctcggcgtagcccttttgggtctagtggcttgctcatttttgtcaagggtgcagtgcgcgttggcttggtcacgacctgtctcttttgaggtcctctctgacaagcttcgagcgcctatcttatcacccagtttacgacttcactacattgctagtgatcaggcgcccttctcattttccacgcggctgttcagcagcagcaccaacgccgtgcccctggcagtgtcctcctccccgacgctccaggggtccgggagggggatcgtctttcccgatggccgagttctctctttcggattcaagccccgacccaggatcagccgcgtcgctctccaaagcaccgccgttttcctggcaatcgcacgtcgcatg

SEQ ID NO: 8445 - DNA, 700 bp, Nannochloropsis_gaditana
  misc_feature (1)..(66): n is a, c, g, or t
nnnnnnnnnnnnnnnnnnnnnnnnnnnnnnnnnnnnnnnnnnnnnnnnnnnnnnnnnnnnnnnnnntgtgcctgcccggcctccccctctccctcccctccgccctcgggggcgggaggatgggggaaaaggtaggaagaaagaggagggtagaggcgaggagaaggaagcgactgacgacgagccccgcctgcacggttcaaagaaagggcatgtggatggagggcacgggtgtgcacgcgacaaggatgctgggatggggactgggcgggggaagagggataagcaagaagggaggccttgtccagacgacccgggcgccacgtcacaggctccctcccttttccgcaagaagaacaaggacgtacaatggaaggaggacacaggcgaggatagtgatgcctcctcctcctctacctcctcctccacctcctcctcctccgtgaccatttccggttccgccccctccctggtcgtaaatcggcctcggcgccagcacgaggaggacgagatgcgggccttccgtcgacggttgcggatcaaagcccggggtgagaacgtgccggactgcctcccttccttctccctcctcccttgccccgacgcctctctcaagcggacgttgctgaggaacatcgagtcctcccagtggaaagagcccacgcccatacagatgcaagcactgcccgtcctggccatg

SEQ ID NO: 8446 - DNA, 700 bp, Nannochloropsis_gaditana
cacgaaccttcaacgagcgtatgcaggagtgtcagtttttccgaggtggtcatggagctggcctctgccggttgcaacgaatttggaagggatggagcgtaagacgtgaggggggaagcgaacacgaaggtcaacataagacagattatgcggccaagcaccgtcaagcaacattggcccccttatttttctattctttggttgtgtattgtctcacccgaattggttccaaatattgccaggttcacgtcatttgacaggagccatcgtgcatgccgcaaaaagcgcgttatgtctggggctcccgatgggaggaaaggcgtgagaacaggagcgaagataccgcgcatagctgctatagttgcatgagcctgtactctgtttttattccctgtacataaattgcgtgcatcgccagtgttttgagaaattcgtgaagcttcaagcaagaatgcaggaggttacatcaacctcctccttccaaggactggacattgtcgagactgaagacaggcaagaaaatcaaaaagcgagccaccatccaccgattccttgcattcgttttccgctacacatcgcattcatctgtcgaagaccgtccagccgcgtgtcaattcattatcctccctcacgaggcaacctcctccctccacctccccttccagccacagacccgtcctgtaattcgaatagcattatg

SEQ ID NO: 8447 - DNA, 17 bp, Nannochloropsis_gaditana
ctttgacgacatcaatg

SEQ ID NO: 8448 - DNA, 700 bp, Nannochloropsis_gaditana
ggaggaggaggcccggcatctggtgaggttgtaggtttggaatggaaatgggcaaccgtaaaaggaagcggcgtaattctaatcccgagcctttcaagaactccctgaaaacgtatagaaagggttaaattatactttaaaatgactgagatcacctttctatttttgcccaacattcggagacatccttttaagcatattttgttgtttacgcacgctgcacgtcgttcatcgcttgcacatagcttgtgaaaactaattggtatcccttcagatcgacgcaacaaagacaagcaatccacacgacatcaaaattaatcccacacatctcgggcaattacgctgcgaaactcccgaaatgtgctcgtaacaaccctttttttcccctcgacaacaaaatcaagggaaagccaggaggttatggtcttctccaaccgggtccttgtgatcgagaccgctaagggcttttctccacattttcagccacattctggctcgaaattaacgtatgtcagggagcatagtcttccgacacggattggattcgcggtatgcggttagatggtcgttgaagctaacattttacgtcatccatccatcccacaggaacaagggggggtaaataacggagctcattccctgttaaaactttgttgcagcgactgcgatcggcattttagatccagacgcacacagcatg

SEQ ID NO: 8449 - DNA, 700 bp, Nannochloropsis_gaditana
cagtggccttgaacgagtcgtgcctgccctcccgcggtcgcgtcacatgcgacgaaacaaaaataaaataaaaaccagagcagccattcgaaggtcgcataattttatggcgccggtggagccactggttgtagcggaccgctcccggcgtattccacgcggagggtgccgcgtctgacccgacgggaaacgcaatggtttatacagtcacagccaaagttgggttggcgggttgtttcattctggttctcgaatgatgttttctttcgtatgctgacttctatacacatgttgtgaggtttagagggtcaataggatcgccattgttcgggaatgtcgtggcctcacccagccgttcattccaatggctagctgtcttccgcgctaaacagaagaaaacatgaacagtcgtagggacctcagaccaggaaaacgtggtcaggtaccgacgcgtacggacataatgatatcatgcacggtatgaagtctcagcagtcactgatattccacccatcgatagggcttactagtgctctcggcttgttggaaggcaaatttccttttttccgataatcgcccaccgcatcatcaccgacaagcacttctccgactaatacatcacctgtcaaatctcctaccatcaacgtatcattgatacgcattttacccattttcctacatataggaagtgattgcgatg

SEQ ID NO: 8450 - DNA, 700 bp, Nannochloropsis_gaditana
  misc_feature (107)..(116): n is a, c, g, or t
ttttcgcgtcacaatatcgtgtcacctacgtcacacctccctccttccttcctaccctccttccctccttccctcttctctccttccctcgcccagtccacgcatcnnnnnnnnnntcccttccctctcccccctccctgtctccctacttccccccctccctccttcccactcgtcaaaagagggtcgactgccctcctctctccacctcacggctcctcccctcttcttccctccttgcccgcccgtccgcaggctaccccccctacctggtccgcgccctcttcaccgggcgggtctccccctccctagcgcgcctcatgctggctccaccgcccctcccctctccttccgagcacggaggagggaggggagaaggagggaagggaggaggcaacggggcccgtggtggtaagtgttaaggtgaaggtacgggcttggtggtgcccgtatcttttccgatctggtagctctgtcttcggtcgcccccccctcttcgctcctctttcttcgtcctgatcatcaggaaagcgccgccggctccactcttgagcacgcaccccctccctgccaccctctctcctcccccctcccttgccaggcacggacatgttgaaggggcttctctccctctccctcgtctccgagccccagcacacgcctcagcagccacagcaaccgagacgactgggtgggcgac

SEQ ID NO: 8451 - DNA, 700 bp, Nannochloropsis_gaditana
  misc_feature (391)..(400): n is a, c, g, or t
cctgatcgaggaggggcctggagaggacggagagccccccgtgcgtgggcagggagggagggagagcgggggcaatatggaaagggaggaatatggaggagtagtgagctcagtggtcgtgggatggtagaaggctagagcttgtgcttgtgaagggggggacagggggatgagggtggggcaaatacacaccttttcacgggaatcattcaaaacctttgaatttaaaattaaaatcgaatgctcctctctatattcccctggtatttgagtaggatcgagcatcgatgaagacaagccgaggccgggagcttttcttcctcctggacgggcaggttcgcattcaagtgcgcggacaaaaagtggcccgcctggggtgaggagggaaggnnnnnnnnnnaaggaaggaggaaacaggggggggggagcgcaagaggggagggagggactcggatagagtttgtgtttgtgtgttgctcgcgatacttccgtacgacgcgtccttcacgttcaacttcctccttccgtccctcccctctctcctgttcaacttcctccttccgtccctcccctctctccctccctttcccacatccctttcccctcgattctgcccttttctttccagcaaaggcgactttctcggggaggcatcctttgtctcaaacaggagagggcctcgctctgtcaccgccatatg

SEQ ID NO: 8452 - DNA, 700 bp, Nannochloropsis_gaditana
gaggggcgtggaagacagcgatgctattctcaatgagtcgtttttcgatctgcatgtgtctgtgtagccacaagcctatcgtgggagaggggaggacgaaacgggagcaggagaaaagtcaggaaggagagtaagaagcttttaccccggaaagccttcaatctcacctgcgtttcattattcatacgcacgatagcgggatgtgggaagagcactcaagtgccgaaattcatcattcaggctgaccccttggcccgcctggtaggtctcctagtaatctctccctctcttccgtttcttcccccccctctatcctcgtgagcgctctcattttttgcgcattttttcttcatatcattcctttttcctctccctttgcccactcatattgtgcgtcccgattctgcttctttctcatgctgtctgcgcctcattctgttcgcctcccttcctccctccctccctctctccctccttccctctcgtccttcatcaccaggcaatcaccacacccacccggaaggcggccacaaacctggccaaggaggtcgcgcgccagctgggagtacgtcttttccctcctctttctcctcgtactctcgattcttccctccatactcgccaccccacgacccctaactacctcttctcatttctcccctcccgccctcctcttcctcccctcctctcctcccaggag

SEQ ID NO: 8453 - DNA, 700 bp, Nannochloropsis_gaditana
agaatccgaggagattatgagtgtatgctgaattatagaggacgcttccgattgtagttgctagggaataagctcatgcaggcgtttcattttttggccgtataggtggggaggttattcttcgctacattctggagtgacgccattgtcataagctccatactgcaacccaaaaaaaatgtcaaacactgtctccgatgcaacatgatccccccacagatacatttatttacatcgatgataataatgtgcactttgatcaaaatgtaatcgcggcattgtcatcaagtcagtaatttaaactcctctcaccatgctgaagttaactacaacgacaatactcgatgcatttcatgcggcatctttcttaaaaattgcttcaggccagacgattgctggtcgtgtaaatggttaagctgaataagaagcttttaccttcttttcttgacaaaatttcgtgcaggtttgacttcaggcacgttttaaaggaggaaggaggaggtgaggatgactatgaacttggcaaaatttccttgctgcttttacatctctagtggccgcgccagcaccaccagcatgagtagcatcagtgaagacgtgtctatttgccggaacaagaagatgatatttgcccaacaacatcgactacgcccgcgacgtcaagcgtctggtcgcttttcgacaccatgcgtccaccatg

SEQ ID NO: 8454 - DNA, 700 bp, Nannochloropsis_gaditana
  misc_feature (1)..(363): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgtcccttccacacctctctcccgctccgcctcttcctccacgtccaacatcagctgttcgagttgcgcgcgactgtagcgcttgaccgcatgccggagccgtaaccagttgtatactgtgttagatgaggcggtggaagaagaggtcgaggtggaggagacaaaggagataggccggagggaggtgttgaccgtcgcgtcgccgcccaaggagggagaaggacgtcgaggggcctcttcagaggcagcagcggctgcggccgccgccagggcacgcgcggttgccgaagccgcgggggtggagaggggcagggacggatagcgacccatcatg

SEQ ID NO: 8455 - DNA, 700 bp, Nannochloropsis_gaditana
gagaatgaagtcgtatccccctttgtcccaaagcaaacaattggacaatatcttggaatcgacatccatgttcggttctgatgtcgaagtgagactagcacgtctttcgtccctcctctccctttctgccttgcgtgcctttgaccaaatgtttgggcagcggcctcggttatgatcctcgcttatcctcgtcagcgacgtctgccctctctcagtaacgccttcccaagtcccacacgctcactccatgcacgggcacgcgggccaaccatacaacacacgcatacagacattgaataaaatctcttcgcaacttatttgtcaagccgcgcttgtcgtcttggcgtcgccggcgctgcatagtagcagtgtttccaaacctcctgcccctacctgcctagctaaattgcttgctagtgctacacaggaggaggggaggggatagctgctcatgtatcgtgctctggagagaaaagttatgctgtggagaaaagtcgtgaacaagcattgaccgaagtgcatttgagcactgaatagatcttgaggcttcacggccgtttgtaaaggacactagcggaactctccgtatctcaacaaagacgaagataagcaagttgaaggctggaaatcgcgcattagaagagcacacgtggcttaagtcgcctttggaaggcgcctttcgcggggcccgccaaggatg

SEQ ID NO: 8456 - DNA, 700 bp, Nannochloropsis_gaditana
gcggtcagagctccgaatccctctccacaatatccttatctcagcagtcatatactagtacgcatatgaacatatattatggcaagaacaacccttttcgcgctcccaatgtgacgcccgtcacctgcatggccgcagcacgccagtcgtgacagagggcaatccagggactgggaagcttgaagtgccggccaaaccctgaccagatgcatcggcttcctctctatactggcgcttttggcacacgcaccgattaggctgcgtcttgacaagactttgcctctccagtctgtgacgttttacttgcatacggcggtgctgggtgcataggcaaagagtctcttctgtttgctgttctctccctctttttttccgcttgcccacagtggtcgtcctccgattgttctcgatgaaggagggaagcgcacctagatttgtttctatacgaaagttttcttcaccattcacctgcagtttctctccgctctggaaaaattgtatcgcatcgttccttcaatttgccttgcagctgcattttgagacatgttagcaactcccaaaaagtgtcgaaagtgctccgttcgatacttgaagttggtttcatatcaatctgctgcctcgccctcttcagcccttcatgagcacccgcttacttcgatcgtgccaatacacacagccaaacaaaaccactagaaccatg

SEQ ID NO: 8457 - DNA, 700 bp, Nannochloropsis_gaditana
atgatagagtacgcttcaagtttaccaccggatgtactgttgcggttgtcgtttgagtgtgagcgaatgctgaagagaaatgatggcagcatcagaacctcactctcctaaggagtgacaaacaatcaggatgccaggcaattgaacgcagacataaaaggactcaaatggcattccgagcaaccaatacaatgctattaattcgtgtaatgtgtacgagcatcggatatggtcgcagacatagtagaacgggagacgagaataatgaggtatgcggaacgtgatgcaggcgccaggggctttggagtcggcggtgaaagcttcctccgcgacctgtcacactgcccttttgccatgaaagtgtcacggaaaggcaaatagggtcaacacacactctcatccgtgtgaccacaaggcaaatcatgcgcgagggttcagcggtgactcggcgaccgacattcaattcatatgcacgctttcccgcgtcacacctccggcgttgctgctgctgcggcttgttccaagtgagggagggggtgccctacaacacacgccaatatgtccaattagagcggtgtaatggaccacttttgcatgcaccgtctcgctcatcaaatgattacctcatgttatgccacaggttagccctatagccggatatgggtacatttagaggcgaaagcgccttagccgcaggatg

SEQ ID NO: 8458 - DNA, 700 bp, Nannochloropsis_gaditana
  misc_feature (639)..(686): n is a, c, g, or t
agcacggatggggtagcctgttgacacctgctgggtcgcttgcctctcttcttttcttgcgttcaggctccctttcacatgcggggtactgtggctctagtcatacaaaagtacccgaaacttctctcctagttctctacagagcgcccctcaggcaacctcatctctctccactcctcgaaacaagaccatcgcctctcgcagacttgctaaatctttgaagattcgaacaccagatttcccttccatgccctctcctccaccgcgaagcccctaccgccaccagtcaggcaagccgcagcattccatccatctcccctacgcgccatgagaaaggcaagggccgcaagagggtcccgcgcgtcctgatgcctccttcctgatcccggtgattggatctaaccgacggttatgaacacccaaaatgcccctcacttttcctcaaaccttgcccagcgcgtcttcccgtcctatcatcccctcgcaaggcctctttccccgcttccagtcctcctcctccactcccaccggtcccttacatcccacgccgggatggccctctcctcctccttccccgttgccgcctccccccctcccggtggctcccgctgcagggtacacaggcccatagccggcaannnnnnnnnnnnnnnnnnnnnnnnnnnnnnnnnnnnnnnnnnnnnnnnccattaccttcatg

SEQ ID NO: 8459 - DNA, 700 bp, Nannochloropsis_gaditana
  misc_feature (503)..(512): n is a, c, g, or t
tctgtagctgcgaatgcgcccccctagacgttttcccccgcattcctcttcgagggctcacgcaccactccatttcattctttctgtgcaccttatcagatacgctcgcgggaaaaccctgaaagaagaagccctcagcaagtacaaatttaacacgcgcgcctccatcgtcaacctcttaacggaaggaaaaggtgtcatgcccaagtacagcagctacacgaggaagaacggggacgtggtgccggcaaaattgacggaacaagagatggggcaggtggcggactacgtcttggagcaggccaaggccggatggaaatgaggggaggatggaggaatccagccgcgtgggagattcctcgttccctcttcacgagtgcgctgggcgtgatttttgaaaggctcggtcgaagccttgccttgtgttgacggtgccctgccgagattaaaaacttgcaatggcagcgtccgctttggatggaatcgctgaaagaaataacgannnnnnnnnnccgaagccaccagctccttgtcgtcatgcaaggccccccggggtcaggcaagaccactttggcccgcgccttgatcgaacgggcggagcgacccccgggagacatggtgatatgctccacggacacgttttccttgacgcacacgggcgagtacgcctgggaggcaagcaaattgagagagaaccatg

SEQ ID NO: 8460 - DNA, 700 bp, Nannochloropsis_gaditana
tggacggctttttgatggcccgtgacaaaccttggttccacccagctcttcaaagagctttgtctgaccccttccggcaagcataggagccgcatgacgtactgcttggctaaaggtgtcagcgactgaaaaacggcgcggcaggtccaggggaagggggaggctgagggcgtgcacgaggaggaggcactacccaagtcttccaggccgtacaatcggtcgagcgagatacgaggaagcgttcccagcagttcgaatacggtggccacgtgtgcggatccatcttccgtgccatgaagttcaggacggtacgtgggcttaaacatcaccctgactgtttgagggcgccaggagggcgcagggtcaggcaatttccggcggcttgaccgcgtcaattaagtgcttgcgtgtccacgaagccattcatgtcatgtgccggtcctgcatccatggtgacgtggaagaacgaaaaaccaggaatgatgcatcggttaaattcaagacataccggaaaaacattttcctgcaccaggtgtagcgctgcatatcgttaacctcctcaccccctagcacaggggcaattgacactacccgttccacaacattatgcccgcgagcggacaaaacatgatataattacatcctaacaaatttctatatctcctcaatcaaagcgcttgtcttggcagaagctggtatg

SEQ ID NO: 8461 - DNA, 700 bp, Nannochloropsis_gaditana
agtcatgtggaaggtacgtgaaaagcatgtgaaaagaccgggaatagggagggtttttcccatgctagaacgaaaccaacagattaggcaattcacgcccaaaatacctttatttcgacccgtagctccacaaatcgtttcgtcacatcccgtgtcgccatagctcctgttcaaggtgaagaaagtgcgtgataagggtcgagaggggtgatggggacgtcgccgatgatgaaaaaaggtcagttgagaccagaaagaaccaaaacttaggctggcactctacaccacgtggcgcgtaggcatccaaagaagtagtgttcacctcccaagggctacttgacgccgacatcaatgtgagaatcatataatgcggtcccagcaagtcatgcaataagacttatgggccgccatggctgttcctgatctcggctccgctttttcggtgacgttgtctccaccacatttatgcgcctttattgcacggtcctttcccctccattgtcctcgtaccttgcacatgcccgcccccttgaatacatccctgcatcggtaaaaggggctgcgcgggtactgccgttgtggtgctcgtggcaaaggtggtttggatagcgcttcgtctttgattttggcgacagccgtttatgatcaggcgtgacaagctgtgatacccgcacttacatcacaatcacgcacaggaatg

SEQ ID NO: 8462 - DNA, 700 bp, Nannochloropsis_gaditana
aacgggatggtggccagctcccggacagcacacaaccgttgagcaggaaacgggggaggggcttgtacctggaaagaaaagggcaaaggtctccgacgccagacggtgctcctgaccaaagaagcaaagccctgcattatgacctggtacccaacttgacgttgtgaggtgcgcgtcataaattgtcagtcaaccaacagtcgcagggctacggatttcctcgccacacttccagaccgttgctacttgctcctgctaagcagccgagagcctcgcacgggactgtcaacgcaccaaacgagacaatgcgacctttttgcacgcgcggccgtcaagatttattccactgtttttggatttgttagactccaagaggcaaagaacgtgcgaagtatttttcatcctggaggcgattaacctcctgcccctacccggctacagcgcttgaagggggctgtctgactcaatacctgtccaattttatttgttgggaatgagaatttgaaacttgcacatgacaaggattaaagtagtcgcaaatgacactttctggcatgttaagcctctgacttgacgtcaagactcctgctgagctcagtgctcgatcaaatgccaagtagcaccctctgttacctagagtgcgcgccctgcacacgctcatcatgccacgactccacacatgtgatacaggtacaccatg

SEQ ID NO: 8463 - DNA, 700 bp, Nannochloropsis_gaditana
atttccgatcacgagcctgaccgagcgaggtagacgatttccttgtcacagtcccctccagctgcagacttatgcattcaaaagatgtccctgaagctggccgagggcgaagtttcgaagaagaagggttggttaggggtaaaactacgacgtccagaacggcccatattttcccgcccgtccgattccacctgttgccgcatcgcggtccaaggtcttttctcgcgggagcgatattcctaggatacgcggaagcaaggaggaatgtgaatgcttaagtacgaaggaatgttatgctcggtgttgtatattcccgtccatgtcctcggcttgtcttggaaatgccaagagcagagaatccgggcgaccaaccggaaggcgagaggcaggtccgatcacgagacgaggctcttacgactgcctgtggattgggccgtttttcatgtacatggaatcgaaaaccggtgcccgatgtagaccaagctctccattcaataggacctgtagaaggccgtaaatcgacggcacaggaaacatatgaaaaggatggtggcaccagcccgagggatggacaaattccgctgctagtggagttcagaatttggctgcgaccgctttgttctcttttccacgtctccattaccctctataattgatgcacgcaagccacttaaatttgactctcccaccgcagggcatg

SEQ ID NO: 8464 - DNA, 700 bp, Nannochloropsis_gaditana
tgaaaaattggttcgatgacgaggatgaagagggcgatggacgcggaaagagacgtggagcacctccgggcttaggcattgggggggaggaggaagaagacccaatagatgcatttatgaaagaacagcagggctcgtgtcaccaaggcaaaaatggcgctctgaatgatagttcaaaagctgtcagttcgacgccgggtccggagaaggaggaagacgtagatcccctggacgctttcatggtgggtgtgcagagtaaagtggaagaggaagcccgtcacaccacggaggctggggtggaaaaacctgtgttcctcgacgagaccgcagcagaggaagaagaaggcgtgagagaggaagaggagtactcggaggaaggagacggggggtatatcagccgtcggcgaccaggggaggacgatgcggactatgactcggatgccgaagtgtacgctgctggggcggcagcagaggcagcagttgcgggcaaaggaggagacgatagggctcttggcctggtgcctgggaagatgtacagccgggtggggccggaagggaagaaggcgatggagagcttgccccctctggaccacgccagcatgtcctatccgccgtttcgaaaatgtttctacacggaggacccggaggtgacggcgatggattgggaagagatgttaaggtaccgggaagaggaattgca

SEQ ID NO: 8465 - DNA, 700 bp, Nannochloropsis_gaditana
tttttttgtcataatgggagttatcctccctcctctccctcctcccttgtaaagaggggccaaaacacattcccccgcaacaaaggaattgaaagctcatgcaaatggagacaaagaaggcatccgacatggtctgaataaaaagaaagtggaagtttctacccgaatcaggtcacgtttgaagcccgcctcgataccagcattgtgctggaagccaagggaaggaacaaaatcaaacgacggctttccctcctctttgccgtataccgcctctacctgacaataaaggcagcactccgccctccttgtgcctccatcgaccacatttcctcaacttcttctgaaagctcaaacattttacttttgcggaccttttggtatcctgtcccaagttcatgtctcgtgtagtcatgccaacactttgagggtggtcatggccctcccccgcccgacctgagaatcagtacaacccattactattgaaaaaggaccatctgggaacgaactcacaacatctatcacacgcaaatggactcagggcaaaaaagggtagacaagcggctgtacacctgaaaaacgaggatctagtggcgctcgtgaccaagagtatcgtgatctccctcccggctctctttgctgccctgcacggtttgaaggcaagttcacattgcgcctacaacaaaaccgagccacgacgatg

SEQ ID NO: 8466 - DNA, 700 bp, Nannochloropsis_gaditana
ggccctgtgggaggaaggagggggggaggaatggggagaggaagggaaggaagggatgcggagactccagcaggacttggtcacgtgggaggtggatcagcttttgtcgggcccatacgatgcctgtgggtgccgagtggccatcactgcgggggcggggggcactgacgccagcgactgggcggggatgttgctgcggatgtacttgaggtacggggagaggaaaggatggaagctgcgaatgctggagaaacaggtgtcgacggaaggggtggggatcaagggggcgctgttggaagtggagggggagaaggcgtacggcttattgaaagcggaggaaggcacacaccgcctggtccggatcagccctttcaacgcggcggggaagcggcaaacctcctttgcaggggtggaagtgatgcccatcctgtcggacgagcggctggaggacgtggtgctggcggagggggaggtggagatgacaacctttcggtcgggcggggcgggggggcagaacgtcaacaaggtggagacggcggtgcgactcaagcacttgcccaccggcctggtggctcggtgccaggaggaacgttcccagatgttgaaccggaaaaaggcgacggccctgctcaaggccaagctcttggcggtcaaagaggcgcaaagggtggaggccctggcagaaatccggggcgacctg

SEQ ID NO: 8467 - DNA, 700 bp, Nannochloropsis_gaditana
atgggcttggcaatggtcccgttccttgagaggggccgggtcagctggcctccctttctgccttttgcccctcctttccctcggatccctcccccccgtcaagtccatctttacaagtgccatgacaccgtccaccttccttcggcctccctcttggtggccttcgtgcatctcggtcaaaggggttccggccccgcgacacgacctgggaagcctctcctctgccagtctacgtaatgggcggagacggtcgaggcgcatgttttcttcctcctccgcgtcttcctccccttcgtcttcttcttctttctcctcctccatcctgtcttccgccgagacgcccattcaggaccccgccgagctcaagcgggcgctcgcggaggccgcacgggccattgaagccaacaccgctgccttaaatctgcccaaaatcatgggggaaatcgattactgcgaacaagaggcagcccaggagagtttctgggagcggccgagggaggctcgggagaaaatgagcgtcttggccgggctgcaaggcacggtggcccgtgtggaccgatggcggcgacagtacgaggacgtggcgaccgccctggccctgtgggaggaaggagggggggaggaatggggagaggaagggaaggaagggatgcggagactccagcaggacttggtcacgtgggaggtggatcagcttttg

SEQ ID NO: 8468 - DNA, 115 bp, Nannochloropsis_gaditana
ctatggtaaggagggagagagggcgggagggagggagggagggaggaaaggagggcctcccaggtgtgtcctccctaccgaccctttccctccctccctctcttccaggtacatg

SEQ ID NO: 8469 - DNA, 700 bp, Nannochloropsis_gaditana
ttgatgcctggcattacatatcattaagacaattgcttgtgcgagggaggatcaaacacgcttggtcgtgttctcagcatgcaagaagtgcaaggagggacttttacgagaaagagggtttaaaccatgccaattccgtttgctgcaatttatgaagaatacgtcaccctattgtcaagatgtcagcggaataagtttttcggtgcattttttgtcgtctgcatgagatcgaacaagacattgatgtcatgacgacggacgcagagggaagtgggattcggggtaaggggaggcgacggagaacgtttccgatccgtttgaaaaatcaaatttccgttgcttgggtggaaatgcagcattcaagacatggatggagaaacaataattgtttaagagttgataagatctgataaattgacacatcaagaaataagaatgcgtaaatgctgggatgcttcctttcaaagtcattagttatattgaggcgcgccgtccacggagccctggccacgatgaaggtctctcattttgccggaagtggaaaagagagtgagtctacaagcaaagatcgataaaaatgacaaatttgcgtctcgactcatttcctctattttcatgcccgcattgtaggcgttagagagtgaacttattgtgccgctgattttctttgttccaacaacgaaacgtttggtatgaactt

SEQ ID NO: 8470 - DNA, 700 bp, Nannochloropsis_gaditana
gaatatccgcgccctacaggtggcttgattggtagctctacataaaattgaatacaagatcaatgcggaggtaaggagcatgtcatttattttcaagtgtggtacacccgcagtgatgggaaacttccgtcaaaaagcacacgcggttgtggattggcaacaacacgatctaattgagctggtaagggtgaattggattctaatcttgacacatcatcagaaaagctaattgggaggcttgtccggtaaaatatataccataacaacttcctttttgtgcccttgattcaaaagagtacccgtctcaaaatcgaggacaaaagaccttttacaaagaaagcagaaggcgggtctatcgccaagaaaacgaaaaaccgtttctcggggcgggcgaaggcgaacgttggggggctgaggcgtggtgctggcaaaaaaggcggtggtacacatgcatactgatccgtcgacgtgagaaatgattgattgagatgctttctatgcctttccttgcaatgtgatgatgcaattgccaggcgttgggtcctcatccacagccactttgacggttggaagagctctttcgacggtaggattccatagattaaaaagttctcgcgcttacaatcctcaacagtgcaatcttctatcacctgctttattatttcaggctaaagtaatcattttcatgagtaacaaaatg

SEQ ID NO: 8471 - DNA, 700 bp, Nannochloropsis_gaditana
ttctctctcgtttcatatctgtcatatgttttcgttcgatcgtttcatcgtattcatttttcgtcatcaacgagctggcatgaacgttgtttgccaaagtggcatcaagtttattttattgaaaagtagatggcatgtgtttgttctgtatctgccgttggtgtgaagcgtcgcccgttcatacttactggatcctttaacatacgttaaacttgctactgcggcaggagaagtcaatggtctgttcaattggttgactgaaaagacttattggaccacatttctccaagaattgatgtgagaagctgtctaagcatcctgagaagtcgtctagtcgtcgaagtcagcgtatcatggacgctgggaaatgcacatccacaccagcagcttcaacgagtggccgtgaattcgatgtgatcatgcttgctctatctgtaaactgcccttgtgcccctgtccatgtgaaaatgacccaggcagtccaccgcatcgcaatgccatgtgtgctcaggaaggacacttcatagaattgctggtcatggatcctccccaaactcgggaatcttccagtccgggaaaagaaaacgatccatgcctaaaagcatcacttgtgtagacgatgcaatttttccccagctccccactgctcccccatctaactttattgcggttgtacacgccatgataacaggctaccatg

SEQ ID NO: 8472 - DNA, 700 bp, Nannochloropsis_gaditana
aaaccaggttgtggaacgtgttattcgtacttcgacagtaagtcatgctcgcgcttgcatattggcattttaacgaatttttgatgaactgtcgtgacgcatcaactgcttctccgtctaaatgacaaaagaagaggaagaattgtaaccgagattattttttgtaattaaagcccgttatcgtaatcaaacattcattttcagccaatgtgtgtctgcaaaaagtcaggggcacacgcttgcgagggcgggaggttagcatgtatttgtttccaaacaccttcacaccaacgtatcatctacaaaatgtcgtgcccgctctcttgaagcggtacatacatggtatgtgccagcgagtacagatgtagaaagcattcatggacatgaaacattttgcggcaagcgtagacatcctctctcccgacaagaatctccgtcgaggcctcggcactgaggaggagctgatctctcctacccgcacaagctccaaaagacttaatatttccgaaaatatttcctcactacttctcgacacccccctccttctccttagaacggatgtgcgagctcatcgattcaagaggccgtggatagtatgaagcactacttgtgtaacgggagccagatagaggagtgagacgcagctgcagcacaagcaaagttgacaagaaggggaagacaacatcaaagaccaacaatg

SEQ ID NO: 8473 - DNA, 700 bp, Nannochloropsis_gaditana
  misc_feature (1)..(618): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgggtgggctgccaagaagggaaggaggagaaggagaaggcggagagagggcggggggtcgcgtcaggccgtgctggaggg

SEQ ID NO: 8474 - DNA, 700 bp, Nannochloropsis_gaditana
gccccgtcgtcctcgtcctcgccatacaggattggagccacgttcactggctcgtgcagtagcagcaagcccaccttctgttgcgcacccatttgagacgtgcctacaaggcagggaatacggtctgtgcgcctggcagtctgcaaggagatgggaggaaagggggcctgaaggggagaggcaggaggtttttggttcccggggcagccgagcttgtggccaattaacgtacagctgccgccgtcggggagagagagggcgctctcactactcatcctcctgctgcaatcgttgtcatgctgtgtgtgaaattggttgggaagccggaacatattatttaatcttccttgagcacatcgagaacggcgaagtggagcaagggagagaggcgaggctgggaatggcttgagtgtcgcgaggaaagaggggaagttactggtttatcccaataagaaagacctgcaatggtccatagaacctcacagattaaggtatttttcttgtcttccttgccagaaacaaaatgtgttttccttgccaggcagcttaattggagcattggggcgtcatgaaatagacatctgggcaccgaggaggagaggcattgagtgcccattgattgtgatcgacatcgggtattcccaggccttccacctgcctaatacactaccacattcttctctttgatgtttctacaatg

SEQ ID NO: 8475 - DNA, 700 bp, Nannochloropsis_gaditana
cgctacatgatttatgaacggataaagcgccatcccaatcacgcccatctccttgatggctcactcaaagcgaatgtatgttgctttgtaagatttcaaggaatgattcttgtccaaaattttgaagcatgtggaggagggtttgatttgatggcaagttatggcgcgaaaagatacttgaagagagacttgcttactacccagggctagtctaagagcgcgttcaaaacctgtcacagagtgtcacaatcttgaccgaagactccttggaaggtgtgaagaaggttcaccaactatgcatccaattttctttgttggattcataaggtttgaagtacgaactgttgagcaagtagtctcatatcacgcaagctttcgctcgagcgagggctgggaatcagccacccaccccagcacatccctgccactcgagtttttaccgcgcgttgacgacttgtgcgctaaaattcgtcttgtgaggcgtatgtgtgaagcatgtacacatatctgatgcctgttgatgtctaatctggaacttaagtgctcatgccgtcaatgatcttcaagctctatccccgcacgtgatactagctagcagcctattcaatctggtagcatcaattcaaagtaacttacggaacaataacacaatttttgtgatcgagtaggcgctctggggttgtgtcaagacagactgatg

SEQ ID NO: 8476 - DNA, 700 bp, Nannochloropsis_gaditana
ctgaagtgtaaggaaaaaagagggcatcgtccgagagtagagactgtttccctgatggataacttaccttgcctgctacgttctgcgagaggcaagcgctaaattagcttagtaaggcaggaatcactacctctgtctgattagatagctatataggtaactatcaagctaactctggccatgatcgactggaatgcgaagaaatcactttaaaaaagccccacggggctggcacttactacgggggggtacgcgaaggacaggtcagcagatcaaagacacctgtgtcagcaatgtccgtgtgcttgctctgtctatgcgctgcatgcatttagactatgaacttcccgcataacacaatgtttcgtgcaggacattgctgagggatctgatgcattgtccgtcgtttgataaaattggatcaagacacacagactgctccaaacccactttcacctcctgcctccccttcatcagcccaccctcttaggttgcaatgagtatctcgacaaatacgccttcaatcaggcgccagcgtggtatcgagcggatgcttttggcagtcctgtcccttggtacagtgttggtgcaagccaaagctttctccttccacggcggcggaggggtagggtcctgcgctaccaaggtagggagcaggtttgtagtccccactctcttttctccgggctgcatgagtatg

SEQ ID NO: 8477 - DNA, 700 bp, Nannochloropsis_gaditana
gcgaaacaaggtcaatatttggcgggcgggccatgaccgcaggcaaagacatggaggaggggaaacggcgagagggactcccggcacgtacgaggaagaatcctcacatgcagccaaatgtactttcaggacagccatgtatctgtttggagatggctatgagtttgtaaagcttcacgaccccatcgtttacatttttatgcgtcttccctccgtcacattttactattcgcaggatcgaccttgtgtacgacgcatcccactcggtagtaccccttttcccgacgcagacagaccaccaggaagaaaatgctttctcaggcaagatcccgcacggagcttgcttttatggaagcgggcgtggagcaagacgtcagggcggatggacgtcggcgcgtcgattatcgggatatcagcgtcactgtcgatgtcgtaccctctagccacggctctgccagagtgatcctaggtcacgacgccacggaggttttggctgtggtgaaagccgatctttcgcaaccttcatacgaacgagcaaggtgcggcacgctcgagttgaatgtggaagtgtctcctttggctttgctttataaagagacaggtcgggaggtggaggatttaaatgcggagttgaccacggcatttgagtcctttctcgtggagtctggggccttagacatggaggcattgtgtattactc

SEQ ID NO: 8478 - DNA, 700 bp, Nannochloropsis_gaditana
tacttatgccggctatatgaccgagcacacgccgtccggtttgcttttgtcctgccgcccgtctccacctccctccctcctttaagttccacccgaggccgccgatcctctccacacgatgttgccacattccttatgcaatcctgtttcaagagagcttgatcttgtgcaaagagagggaatgagtgtgcacaaggccgtattgcagggttttaggggaccatggttggaagcgaaatgttgattgaaaagctcgagtgggaacataaacgtgagctgctgaaatgtagctcgcgctgagtacgatgaaaaattttccacgcttctttattctcatacatagatgctatcatcattccactaggcaaaaagactcagagattttccgtctgcgaatttagcttctgtaaactttgtgatctcagcatgatcgaacgtttacttcggcgccgcgctacgactaactcgtcctctgaacaaggtaatcacgtcgaccgaaaggtttattttaaaaataagtacaaatgatactctatatcttatctgggaaatgtggaatggagtgatcatcctagatcacggaagggtcagcacaattgttgatgctctggaccgtatggaacataaagtatgagagctgacaacagcactccctatccttgcaatttattatccttgaacatacgacgcaggggatatg

SEQ ID NO: 8479 - DNA, 700 bp, Nannochloropsis_gaditana
cacttggccaccgtaatccgtaaaaaaagccgccctcgctgagcccgtgcccacgtcgatgccaagatacagcggcgggtcgtcccgaggagataccatttcactctctggtgtcgaaaaaatgtgtatatgtatattgtccggtcagggggaggaggttatttcaaagtgtgacagcacgacgacccacctcagcactgtgataaggcacgccatcctcttctatgctaaatgcaatcgctattgccataaagtaacacacagaaaggccatgtgcttggaattgtgtataacgttgctcagatagcggcggtacttgctgtagctcgctgcttgttagtaagttgatctcagagggaagcgaagaagggtgaagagatgtgagtacatacacacgcgttcacaaaggaaaaggccttgggcatcagtaaaatatacaatgtcacatgatcaatgatttcgtagaggttgagacgcgtggcttgatggcttgtggtagaaattggaatgccgcggggcttctagcatgcacattaccgtcgtgatagcagtcattctccggctctaggtgcaatggtcacgcaacctttctgagtcgacatgcttctcaattccatcgctttgtatcctgtagcagacgaccgtatcgtccggtccttattctgggcatacttggtgcttttgcgcgtcgtttatcatg

SEQ ID NO: 8480 - DNA, 700 bp, Nannochloropsis_gaditana
gctcgataagcaatcctcaacgccgactatgctgaataaaaatgccatttgccaccgatgcgaacgaaaaaccaatctgggagggatttgtatgatccttgagtgttcaagcacttcggcaagagcccaaacggacgagtagatagagttttggggagtggtggtggtgatacgatccagttgtgggaacgtaaagcaggcatcggtgtgcctatcgtgcatttcaagctcctgtgtcgcatgtttgcgcttgtgttgcccaagtcatgaagagatatagaaattgaagacgtagtgccaggctatattacggtacgatattcaaatccgtgtaatgacaggataacagcgttcttaatcgcgcagtagctatttatgttgcgttacaccgaagcgcggtttgccccctgtacccttttttgtttgtagaggtttgcgggctagtattttcttggctatgaaccaaacaatggtggccatacgcacgtcactacttaaatagtaattcgtgcgtatttttgatgaaagcatgggtttttggtcgagaatttctcggtcgcactcttcagctatcatatcagccttcttattagggtcacgataaagcgtacagtaacatttgagacgatattcttccctcaccgctatacttccctcaccgtactcagtcccttttactctgccctatcgagacaggatg

SEQ ID NO: 8481 - DNA, 700 bp, Nannochloropsis_gaditana
ttgaccagtgtcttcttccaacacgcacacacgtcacggtcgtcctcccaacatcccgtcttgcgaccgacacccgtgacggtcggttccgcccgtgcccacggctttactggtgttggtgagcaaaatcgcttttcatgatctttggcgccgaggccgccccggcgtggggcaagatatgcatctaggcagcgcgcgcggggaatgtaatgccttttgcaggcaaatgcatggatgccgtgtcttgcccgccgaaacgtgttcgtggtggtggcgaaacacacacttgtcgggcgtgcagggtggaagacgaatggtatcgtgtagattctgcctattcgaattgggaaggcagaaggactgtggcgaggcaatatggcgcgtcgcgttcccgatctcagacctcttcatcaatttatgcctccctcattccaggtacttcccaaggtatacggatactgcgtggtcgagcagacaaaattctgccgtcttgacagttgggagaccctcgcatccgaagtggttacggcagggtagcttttcgtctcgtgtacctcctccctccactgcgccttttttccaggcaactgcagattttcctgtattttggcaactgtcagcacgctgcgataataatccttggccagtggagaaaccacaaagttaacaccattccttttgctgcgcgattcttagcatg

SEQ ID NO: 8482 - DNA, 700 bp, Nannochloropsis_gaditana
aaatggcacaccagggccttccttccgtagcgccggcgtttgaggtaaaattaggcattgcaccgatgtatgcccgcattcgttgaagtaatgaatgtggaaaatgtctaggacgtgttatagcaccagaccatacatggtatgtacgcatcacaggacgtcacgtgctacaattgatcctgccagcccctgaatatgcccccaaatgccaaacctgacagatgcaacgacgtttgttgatgggtacatagactttaaacgcagccactatgccagatgcccagtatttgcgtcatgtacacttgtgtggatgacacgccagcacaacttcgttttcatacactcaactctgtatgcagcgagcaccgaggcggttgccatttcctgcgttttccgtttttccccaacgaaacatccgtctctgccctttgaaatatttatcccttacagaaaattgtcctggttgtgagcgctttcgctgctcgctttcgttttcccagccctcgtgagtgtaaaaaagttcaacgcaacttccaggtaggtcggagaagtatcagaagggaccgagtgggcgaaaaaatgtaagcatttgacataccactcgtgacatttggggggcagcacaggtgtggcattatttataattttcgtcctctaaggtaccgcgctgaagccagacagcgcgaggcggagagagatg

SEQ ID NO: 8483 - DNA, 537 bp, Nannochloropsis_gaditana
  misc_feature (301)..(310): n is a, c, g, or t
ctccctccctccctccctccctccctcaggcacgcgtaccccttccaggccgtgccctcccccctggtcttctactatactttccagctcgggatctacctccacctctctgcctaccaattcatcgacacgcgccgcagcgacttttgggagatgttcgtccaccacgccgcgaccatcttcctcatcgtcttctcctggctctcctggtccgtccgccctccttcccttcctccatccctccctcctttccttccaactgcttcctcctcccttggcttgtgcctctcctttcttggannnnnnnnnnaacggttcagcgcctggagccacacatggcaattgacaaaatgctgcaagaaaaagagtttctcattctttctccccacaaataatgaatgaatctcgaatcgactgtctttgaagccaacggtccggagctagcgcatcagatataggtgccttcttcgtgagctttttgctatttcctcccgtgacgccgcgtcctgacgttcaactcttgtttcattcacaatg

SEQ ID NO: 8484 - DNA, 700 bp, Nannochloropsis_gaditana
ctcacagacaaggcaaagtacaacgagggtgaggagagggcagacgcatacccgaccaaatctcatgccgaagataattcccttaagcttttgccaccaaactgtgcagtgaaaagagatgatagtcaaggccaagccttggggcaacgttctagagcacgaataggtggcaaattccatccattattatcctttccaataccgatctgtcgttcttgtcatctccagctgggagcgacgctcgtccggctttttctttctgccctcacaaggtagttggtgtgcctcgtacccgcacactgcgaggcccttgtcgtccatttttaataaacagaaaatgacgtagtaaactaaaaaagggggttcggtcggccctcgtttttgaggtttgtgcctgaccatggactcgggaagcgaacgggcgattgcactgagcggacaattgatatcggctgccatcaaattcactactactgcgaaaatcttcctgggaaacgttatgcgatattgtagtgagaacaaaacgaacagagtacgaagaggacgctcgtccagctttcgtggtcgcattatggggagtaccctcactttctattttctttttcctcactcattccttcgatacttgcacgcttcacactcagacacgcagcgcaaccaaaaacgccggaattgagttcatagccccaaaaaagtcatg

SEQ ID NO: 8485 - DNA, 700 bp, Nannochloropsis_gaditana
  misc_feature (1)..(350): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagggttgcgagaaacacaagtatcagctcgtggctgcacagccctcaatggctctgactcaccttgagccactttggcccgtccccctcctccctcccgccctccttcccgccctccctcctcaggtcgacgccgcaagcaactatgcccacggctccaccaccgcgtccatcccccctccccctttgcctcacccctactctcaccacgggggccagcaccaacagccaagcaacctggctccgcagcagccctccatcatgccctccttccctccgcacatgaacgcctccatgtcccaagggggaggagggtctatggggaaaggaggggggggagggaagaag

SEQ ID NO: 8486 - DNA, 700 bp, Nannochloropsis_gaditana
ttctctacaaaaacgctttcctttaatcacggcaaggcaaggtgggagggcaacggcccatattgggaccagtcctccatgcgttcagagctatattatacaattcgcgaacaacaactgcccaacgccagctaacaactcaaagtatacttcgtgtgacgttctcttgtgcaaacgagaaatctttcttccaggaaaaatgtggtatctgtctgccagcaacctcctcgctcaaatttgtgaagcaacggcggcgaaaggctccatgatgagctcatagagccgcttaaaataataccttctactgatgctgagttgacgcgtattggtcatctccccatgaatttcagcccttgatgtaagaacgacttctatttatacggtgtcttgtgacgctcggtctgcgcaagggaacaaaacgggtcaaatggaaaggggagagggtcggcctcggatgattatctagaacgtgttctcactgctatttggctacaaaaccatcccacattgccctctcccggtgtgtcgctgtgcatgtgtttggtctttctcctcttactagcttttttgcttctgatgaacgctctctttcgactaaacctgcccattactgatgtcatctcgcgagttcggatgacacggagcaccctcagggctggagtaagtatcccctccctctttctcactctatcccacgatg

SEQ ID NO: 8487 - DNA, 700 bp, Nannochloropsis_gaditana
gctggaatagtgctgtctacagagctccttaaagcctctcggtttacaggagaccactgtgacacgcagatgaagctggacaaggcacgtagtaaactgcacgggatgagctttttgtgcgaccgatgtggcacaaacgaattcaactttattccaaatattataattaatcatgaaggagtagacgataccctctttgcgtgcatacgctacattattgaaggcgagatgattacggatgtgtggcgtgaattccgatccatgctaggtattctgtaaatgtacacaaacacagacataattgaatttgatcaggaataaggacataaagatgaagtcttatcattataaacctctcaacctcaaagaaaatcaatactttttcgcattctttgatcaatcacaaccacctaggtagaaaactgatggtgagggtaagtttgaaaaaccgttatccggaaccgttgagcaggcccgatcccatgtccaattggagaaagatttatgccatcttcatacaggattttcttaattgtactcttttgaagctaccaatatcgtatgcgttacattctatgcaaatgactgatgcacagtgagcactttgaacatggatatacgcatcgaagtttttactcttgtaccgctttacctaggcagatcggctaccgagcgtttattgcctgttgcccaaacaatg

SEQ ID NO: 8488 - DNA, 700 bp, Nannochloropsis_gaditana
  misc_feature (620)..(629): n is a, c, g, or t
gagctcacgggaacgaggcggtgtccattccctccctgagcaaacaatagggtgacaaggggacaaagtcctaaatattgtttcccatttatgatagaaagacacgcaatcggggcccgcacaggtccgtcgatttctgagcgcgtacacactagggtttaagcacgtcgatcggaacggcaactacaaccagcgacgcttttagcgccactcacccaaagtacccacaacaacttgagtcttccggccttgtgtctctgcaacagtccacgtgtggttgctctgtatggagatgtgtcaattgatagaaaaaaggtttaaaatgcggcagtagaaagaggaaggggggggggccgagaaaatatctggtgcggctgcgcgaggagtggattgctaggaacagaggtcacttacaaggaaagaagggcaaagaggagtggtactatcgtctgacatttgcctttcgatacatttgcgccgaaagcgtgggctatctcacagtgtgaggacgtgtatttgtgaagtcggcttgataacaaagcccttggcgtcgcatcagcctcacccacctcctccctccctctccatccctttcccttcgtttcaaatctgaacaaagnnnnnnnnnnctccctcctcttctcccccccccctccctccctccctcctccttccctcttttcgttcttcatcgtcaatg

SEQ ID NO: 8489 - DNA, 700 bp, Nannochloropsis_gaditana
  misc_feature (224)..(239): n is a, c, g, or t
tctccttagactcaccgtggacgctgtagcagggacggctgtgattcgcgcaatttctgggcaggtctgtcgctttgtctatttctagtccttctcccactagagacttcaatccttttcttccttcctcaatccttccctctttccttccctccttcgctccccccctttcccaaaccttttttcctcctcctacacctttttatttcatccatctgaagcgnnnnnnnnnnnnnnnngctcccccatccctccctccctccctcccttcccccacccacacctccttcgatcccgcccaccctgtgcatgaccaatacacctatccagacggcacgtgctcaggttggtggagcatgcagggatgaggaaaggaaaagagacgaaaggaagagggaaagcagagagagaagaatggaaggggaaacgagtgccctgggagcggtggctgcgcacccgacatcgcagcaggacgaatatcgattcaattggcacatttatttcagtcaattacgaaacgcttactccttgtgtccctcttatccccttccttctctccctccctttcaacccccttatcccagacccgaatggcatcgcttacagcgaaggcgggtacacctacccgtacgacaccttttttccttcttctttcctgccatcctatgtctcggaggaggaagctgcctacggctacatg

SEQ ID NO: 8490 - DNA, 700 bp, Nannochloropsis_gaditana
  misc_feature (1)..(597): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcggacctttaatacaacccacgaacaacgcttcacccatattcccgcgtattatcgcgtgacattttctatttataccttacagacatcttgacgatcatg

SEQ ID NO: 8491 - DNA, 700 bp, Nannochloropsis_gaditana
  misc_feature (484)..(493): n is a, c, g, or t
atcctttgctatcatgcaggtgctagtcaacaaacgggtagaccgagagatggcaggtagggcccttattttccctgctgtccgcggacagccggcgatgtcggagtgttccccgccgcccttccttcgcgcctcttcattcctccctccctctccttctcctcccttaccgaatccacaggcgctgtggtgcaagaaatcggccttacacggtccctctcccacgtgcacatcgtccgctacttgggaacccaccaatgcgggagctgcttgaacatctttttgggtgagtatgcggacgaggaagtccgagaagagggcgaaggacgccagtaattgagaggaagggggcacttcattacgatacatacatgaaggaggaagcggtggagggcagggagggggggaggggaggggaagggagcgaaagaagggcccctcccacaaaatcctggcatcctcacgccctcccatctcatcacannnnnnnnnncgggagggagggagggagggagttggcaaggagcgaccgagaggggagaaaggtatacagggatgaacagagcaacgccacgaaactgttgctgcgagaagtgaaaacggacaggatggaacatggggagagagggaggcagagaaagaaggagggagggagggaggaagggagggaaggagcacctggacgtcgcgtgtgagaatg

SEQ ID NO: 8492 - DNA, 700 bp, Nannochloropsis_gaditana
cgcaatcggcgttactcacgctcttcttaagtgtagtcaacgcatggcaactgtgtgtgtcattttcccttcttgccgccctgcgtaaaacgcagactgtatcgtcacttcaatccagggagagaaactagcaatccttggctgggacatcatcacttactgtcataatttaacgcgtcaagtgatgccgttgattttttaaaaaagcaattctcaaggaaagtagtacttctagccagtagtagccaccagctacggctagctagcaggcaatacgcatatcatcctctttctttcgcgcatctgcatcaagaacaatacggttgaatacgatgtgacgtaaaatgtagcgtcgattatgaatgtctaatatattcgcagaatgtttcaatttatatacatatttgttgttggaaatattatggagggtgggactctcgagaaaaggcttgactccccacaattaattcctccattttttgcccttctcggtgacgaaatcacacccaggatgaatatttgaggtcttacatactttgatgaccagaaaggaaaaaagtatttcggaaaaaggtatttcagtctattgaccgtgggggccggcgcatggacggtgcgtctagttgttttacagatagttcccaatcgacagatgcaaaacgccagattttgcacgtaaactaaccatcttttcatgatg

SEQ ID NO: 8493 - DNA, 700 bp, Nannochloropsis_gaditana
tcttctttttgcctctctacccgttgccccccgcactcccgtggagggccgtgagggagggaaggagggagggagggagaggaaggcagacccgtcccctccctctcccttctccggctctggcgagtccagggcgagtcggaaaggagtagaaacgatccgtccgccttcaccatcaccacctcctcgtcctctctcccttcctcctcctcctcctcctcctcctcctccccagcccccacggcttgtaagacttctccctccgcgtcttcccttcctgttccctccctcctctgggcgacttggccggatctcagagggcttgagtacgtctccttcttttctcctgccacctcttcctcctcctccccccatccttccccctcttcttcctcctcctcctcctcgtcgtcgtcttcacttgtcatcggcacctggtcggtctcccctccgtcctcatcatcccacaccgccgcggacaccgattgtgacatccaccttttcgacccatttttctggggaagggcgcaggaaacgtccacgtccatgctgttaattgtaccaccgctgcttaggctgctgatgctgcactcatcgctgggctctcctccgttagagcccggaaaagtcggggatctattcgcaggagataggaaaggatatatgccactgatggcgaaagaggatggaaaaattgatg

SEQ ID NO: 8494 - DNA, 700 bp, Nannochloropsis_gaditana
ggagtcgggtgggcattcagtatacgtctcttaaaagtctcaaacaatgcattaattaagtcgagagaagcgtaagggaaaagaagagctagttgggtggaagctagaggtgccgcatgcatcaaagcaaacacctgacttatagaaaaaacaagttatcaaatctgatgttttcccgccgtagtacacgccatcatgatggtgccgcattcccacagccaaaattatgttccctgctccctccccacatgcgcaacatttccattaacgctcaatcaaggcgctagacattagttttccaacttcactctagtctggcactgaaattcagagatttcctgactgaaggacgccaaattttgatttttttcggcagcaattagtaaaaaaccgtcgagtggcacacgccccgtcccactgctcgtcccacatttcacactaccgtggctgctactactgctactgtagacgttgcctgctagaaatcactaggttctgatcgaaaaaggacttgtctcccagaaaatccgccgtactcgttgcgctcggtttggaaagagagagcatggccgagatgactgaacgagtgtcacgcgccataccatgctcgcctggagcaggaaccacgaccggcccatcatgacctccacgactctttccacggcattccacacacagaagtcgtccgagcgtcaagatg

SEQ ID NO: 8495 - DNA, 700 bp, Nannochloropsis_gaditana
  misc_feature (63)..(674): n is a, c, g, or t
tgtaagtcctcctccagcgctccatctccttcatcccctccttccctccctccctcctccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggggggggggagggagaggac

SEQ ID NO: 8496 - DNA, 700 bp, Nannochloropsis_gaditana
cctgtctgcctatgaggacgtccgcgttgtccccccctccgaatcggtgtgcggcaacaaaggcgtccagtcgatgataataggcacccaggcacacgatgcggttgattatttccttctccgctgtgcacgtgacaatatcgtgggggggagcgaaaacggacagaaagcaattctcaggtttgtgacctttcggctcgaaccaggttagttcctgcgcgttccgaccagcacaagccctgccaatttatgaaatcgtccggtcgtcccaacaactttgttttcacagacttaccggcgcttaaaaaagtgatgtccggagccacctgatacgtgagagaggagcaggaagaggaggaggtggaggaaccgggaagtcgcacgggaattatgacgtccccagggatgcccaaggcggccaaaaggacctcatgctgcatttgggcgcccacctgtcacaatgtaagggttttcgttatcgattgaggctccaaaccgacgcgcgtcgcgaaggacgtgctgctcgctgatcttgtccgcttgagcgaggaggtcaccaaggatcgagcagtactttgatttatacaaaaacctccctgtctttcggcgcatacacagaggcgaacggctcgggacaagggaaaaaaatatgtatttagaacatttgcaggctggataattgggagagaggggatagatg

SEQ ID NO: 8497 - DNA, 471 bp, Nannochloropsis_gaditana
tggagcctccctgatctgaggtctgcacggcggcaaggttctgtgcatgatgggatggatagtcgaccgggatgcgtcagattgagcatcgcatggcgacccttcaccagacttgcacacacgatggggccaccatcgaagacaggggcttggtgcatattgtgtaatggcttgcatccacacacgtaccatgccatccgacgaggaggcgatggcctgccaactactggaaccagcgtccgtttgctccgtccaggtggcgcccgcgtccgtcgacgtatagatggagcctccattaaccacggcggcaaggttctgtgcatgatgagatgggaagtcggccaggaggtgtcacatcgagaatcgcatggcgacgtttcaccagacatgcacacacgatgggaccaccatcgaggacaggagcatcgtgcactccttgcgtaatggcctgcatccaaacacgtaccgtgc

SEQ ID NO: 8498 - DNA, 700 bp, Nannochloropsis_gaditana; identical to SEQ ID NO: 5100

SEQ ID NO: 8499 - DNA, 700 bp, Nannochloropsis_gaditana; identical to SEQ ID NO: 5104

SEQ ID NO: 8500 - DNA, 700 bp, Nannochloropsis_gaditana; identical to SEQ ID NO: 5106

SEQ ID NO: 8501 - DNA, 700 bp, Nannochloropsis_gaditana
gtcgcgaggctcgccgagagcatagaacttggcacgggagcggtctacttctatccccgtcttgcaacactcgtcctgactttgagtaaatcacaaatcacagggcgctcagagcagtttgctgcgtcttcaacctcaataagggaaagaaaaagtggagagtgacgggaattgaccccaaaaaaacttgcttctggtttctacccgcctcaaacctccttgaattcaattagccatgccccgaatggaacttatgggacggcattaccatattgccagcgacgcggtaaccgtgccagctttctgtatggcagtgggtaggctagtgtggtcggcggtggtgctaggtcttttcttgcacttgcagtacttgttgcagtcctgctcgcgccccggcattgtcgatacttttgttgggctctcaatcaccctctttctagccacggtgctggtggaactggcaattgttgcagtatcacaacgtggttctattgtgcatacgcaggcccggaaggccgtgggtccgctggtcgcattgcatacttgtctcggaggtgtgcagctcgtggttgccttggtaggattggtcatcctctccaaccccaaggcattggtcatgtgcgacaccataagccttcaaaatcgcgtagatctcatcgtggccctcatagtcatttcacagcttgcggatgtttccatg

SEQ ID NO: 8502 - DNA, 700 bp, Nannochloropsis_gaditana
aagtttttaaaagacattgtgtctcatagatcgcatccgcgtactgaattgatgtgtcagaaatgtaagtttttcgttcatctcaagtagataaagcggacctacttcaaagataacaatttcgtccacgactgtcttttcaggacaatcaataggggcgcaaggtctcaacaaatgaatccactgtatgtttacgctcagttttgcttagtgcgcacccagtttggtgtttgatgtacaaaatggaatggttaaccctgtcgtcgcaccgcctcagtctcgcacaggcgtcgccgaccaaattttcccacaataaaatcctcgtgcacatcgcggcaaatctcgagcactgtcaacaacatgtctctctcagcggacgaaattgtaagtgctacgctccttttcccctgtcccatttatctgatttttttatttggcgaccttgcagactgctgcgacaccccccctccttggatcaatggaacttctttccatgatatagaaagacttctaatatctttggtatttcaggtgatatttgtcccgctttcgcttgtcatgcatatctcggggaccgtttctctttaacttgtgcatttttgtttgctaacctcacgagttatgtcttgaatggtccgatcaggtcgacattgttgacgaaagcaatcaagtattgcgccaagagcgtcgggaaatcatg

SEQ ID NO: 8503 - DNA, 700 bp, Nannochloropsis_gaditana
gggaagaagtcacacgacaaagctgtctggggccattaacaaagcgcacctgatctccctctcctattgctgcccatcgctctccttatcatgccggaaccaggcgtagcccacgccttttccctgcaacttaatgcacgaatgtgcctgtgatgcatggaagtgtaaggcatgcaccttcctgacaggccctaatagactgtacggtgccccaatgcctgcgtcgtgggtgctctgtgctatccctgaaacaccgcgagaacgtgtttcactgctttcacgtccgagcctgcctacagtggggtgcacgaataggaattttaatgtgaaacaagcgaaggaagtgctcgctcccagcgaggagcgagggggctctggtaaagtcctgcaactataatcaaagcctgggagggaaaaacgcacatctcagccttcttttcattcgattgaacgctcttgcctgtccgaaatcgtgaggcttggcgcacacacgacggcatttaaatgtgggtgtaccggggaaaacctttgattcatgcttttggcatctctctcgttccatgctggcgcttcctgtcctgactttccttccacgtgaagagttattttaggtgacgggatgactgtagtcggcacgccacccagtagtcaacgagacaatggagaaaacgggtcgaattgcagcgctcttcacgccatg

SEQ ID NO: 8504 - DNA, 700 bp, Nannochloropsis_gaditana
tccttcgagatggtggcgtgtcttccctacagacctctccactccgtcccgcttggtcgccatcacatatccacccgctgccgccacttacttacgtaacccttccctgtgatccgttccctgcccttgtcgcaccatcccaggggggcgcccacaagcagggtccgaatctgaacggcctgttcgggcgccagtccggccaggcggagaactactcgtactcaacggccaacaagaactcaggcattatctggggcgaagacacgctcttcgagtacctgcttgcccccaagaactacatcaagggtaccaagatggtcttcgcggggatcaagtccgccaaggaccgcaaggacctgatcgcgtacctgaaggactccacgtaagtcatgcactcgtcaccctgtcagacggaagcctcgcttgtgtctagggatgaccccttgcgtcgcctcgtcacttattttgacggtctctcacatcctccccgtgcccgctctcccccggaactctttcagagcctaaagacgataggtcgtatggcactcctacatttttgaccgcgggggggttagaagttgaaagaatggaagcggaatgtgtgaattagatgacatgatgaaggatcggaggaatatgaagcacggatgagggagggaaggggcgacgcgaagcaaaggggcaagggacttgctgcatg

SEQ ID NO: 8505 - DNA, 700 bp, Nannochloropsis_gaditana
cccacaaagcctatgtgactcccctgtttgtcgatcgaacgggaaagaacgggtataaagagggaacgaggggcggtgaacgcattgcgtaagaaagaaaagtgatgggttgcgagactcgagaaggagcggcggggaacgcccgagccattcggcagcctaagacttcaaacatacttaatcattttcgtctcattgacagaaaaaggattccaacgtggagacaacacacagcaccgtgcatgtgtcggggccgtggtgccccatgctgtcgcaccctggccacgaaatgcggagaggggcccaaggcctgagtgctcatcctcccccgcctgcccccgtcttggcgccttcgtcctcagtgggaatgcgaccatggagtccatcctgacagaggcagcgtggggtgacgcggttgtgtttggccttgcacggcaagtttacaatgtttttggcttgcgtgatacactttgaaggtgcaactagctatcttggggtgcgctgacctcctgccccttggccggagcgagagctcctccgttgaagcttcgtcgtccttgctattagttctctgtgtggtcttcactgcgttatttcctcctcttcccttctacataggtggcgcgcgcgcggttctagggagggagacaggcactcccagcgtctcggcctcaccaaggtcattgccagggccagtatg

SEQ ID NO: 8506 - DNA, 700 bp, Nannochloropsis_gaditana
ttgaagccgatgtgcgccaggtccaggtgtgaatgggccgcggtcaagcatcgccaccattcctttttttccaccacgttagtgtaggaaaatgcaaccctgtcggcggacacgcggtggttccaaaggaaaaaccagatgacgaccaatacggcgcaggtgactgccgtggctggggtgagaaggaggtcttgaagaaagggggaggacggcatgctcccgccgtgtataggagcactgtccgggatggagctctttgctccttcgttcccgtgtattacggatagcgaagctgcaaacttccgtatgggacgcacccgtgcaacgcggattttttcacacgatgcttgagggtgacaggagagccgacttttgaagagacgccggggaggctggatgacaagttctagcgatctaagtcgtacccgcgatcgacaaaagctgacaccgcgacctacacgcttgggaacaagccctgtgaacatgtgaaagagcgtggtcaaccgtgagatgcgaagaaaagcaggcaggcgaagaattcaaagagcacacgtccaaggcgaaacggccggagtttcggcaattgcacgcctcagccaagaggttgtacaggcgccgacccggtgacctgcacactctgtcgggagtctcaccgtcaacatgcacagtttagcgttcataggttattaaggaggtcatg

SEQ ID NO: 8507 - DNA, 700 bp, Nannochloropsis_gaditana
gcgaacgtggctatgtagtgcaaggaaaatgtttaatgtaggtgtcgaaaaaatgacttttgttgccttactatattatattattactgtccaacgccgcagaatacatcgcatgaattgcaaaatacgagtcggaggaaaacatgacttgtagccaggcattgcaagatgtgtaaacggtcaataatttcgatcaaattttcatgggtctcttctattctaaattaagttgtacgacgagttggttgcacaagaataaccggatgcaaggtgcaaagaaggagaaacgtgggttcaaatttgaaaaaaaaaaccgactaagttagtgtataacggtcacggcggtttcacaatatttgccccccctcccgcgcgcgcacatgttttgagggggaaacaatttttgggacacaagggaatgcgaaattggcatactatatcgcatgagtgttaagatcgttattacctttaaggctaatgcgagctgtaacactactgtcaatgtacgcagtgacccaacctttgtcaagtatttcatctgcatgagggcacgcatacctaaaaatgaacatcatctgatgatgagcttgaaaagtgatgcttaacattaaggtatttaatttgatatcattctcatcatcccttcaattgcggcacatacgatagttaaagctaaaggataatacacacttcgacaatg

SEQ ID NO: 8508 - DNA, 700 bp, Nannochloropsis_gaditana
gagacagaagggcgccggtgcagagctctaagggagaaatcggaggtggaggaaagggaaggatggggagaggtggaggaggaggagagggaggacgagggaaaaggggaggcggaaaaggaggagggaggcggagagaaagagaaggaggaggccacgggacaagaacggggcggaactgggcagcaagggacaaatcaggacaaacatccgcaggcacggcagaaagaggcgcccgccaaagccgtcatcttctcccagtggaccggcatgctcgacctggtggagacggcgttggaggggcgaggctggggctacgtgcggctggatggaggcacgtcccacgcccagcgacgggaagtcttgcaggagttcgccagcaaccctcgggtgcgagtcatggttctgagcctccgggcggggggggtaggcctgaaccttacagcagccaacatggtgattctgttggatccctggtggtgagaagggggaggggggcgagggaagggtggaaaaggggagggaggtggtatgggatgaattattgggtaaggggtcagtcaagataatgccctgaagggtattgacgtgggaatcgtcgactgtcttttccctgtcgtcctcccgtttccaggactgcgatcagcattctgccagcaagcccttgcattttcatcaccgctttcccccacaattatca

SEQ ID NO: 8509 - DNA, 700 bp, Nannochloropsis_gaditana
ttgagctgtggcaagtgctctgtatggaaaggttagggtgcgggctacttaaggggggaaagggaccaagatccttccattgcctgctactttttccacacattagcaaggcgaaattacgcgcatcaatctctcatatcgaagcgtgagactgcgcgcatgtggggtcataataatacggaccgtggatccaggaagctgaccagacaaggtggaagagcgagaaaggatgtagatgcggaagcaacagaagcagaaaagaaagcgggatgggaggttaagaggctgtgcaatcgcatgacactgatggcgtgcacatgcacacacggggcccgcaagggatgtcaaaggcacatgcaaggggactgctagggtccttgttgttcaacttgcagtgtcacatgtggcgacttttctgtcctttaacctttctcaagccttctgcctcgccgatgctctcgagcgatattttcccatgtcttctaacacccaatctctgcccacgtctcatcaaggaaaggcacaaaggacaccgacaccgggatagaataaaaactacacgggactctacaggctgcataggaagaccatggtgcgcgcagaaaggggaagaaacacccaagaatcaggacgaggcgcctatctactaagtgttttagcgtcgctcctgccactcttggcacccggaaacggacagatg

SEQ ID NO: 8510 - DNA, 700 bp, Nannochloropsis_gaditana
gccaaaaacaggcatttttcatcctctttttgaatcgaaatcttccatcgtgtgcagatagagcgatttttttcaatgagcaacgccaggacctgatcaaagaaaagggccgtgggcctgatggtcccagcaagtgacaggggaaagatcgagaactatgccttctcccactgcgcgctgtgaccgtgcatctcttaacgtcccttgcacgagtacaaagtcgtcataagccgtacaaattgcatggattaagaagggaggcaatttaattattgtttttttcatccacccccgcccccgagacctgttgtcatgctgcggtgacaagcaaaggatcaaaatctaacttctttctcagaacacttggcacgcctcaccgcaccagccatgtctcttacatgctgcctctgcgggttaactacaacacgtgcatcccctgttgaccgaagtaaaccggtgggaacgcctttctttgcttcgatgctgccgagtgacctttcgtttactctatcaggccccgtttcccacaacggatgaacttgtgctaaaaatgacagagaaaacaaaagtaccggctaaacaggacgcattatgtccgtcctgcacaccaattatgtccatgttatttgtaaacttcctggcctgatctgtacgcacccctccgtcttcctctgcttttttctccacaatgccagcaatg

SEQ ID NO: 8511 - DNA, 700 bp, Nannochloropsis_gaditana
gaaggtagcgctcctgagggaggaggacgtcgccgatggggaggtcgcacttcccgacgcttcccactcccctccctcctcctcagctgccacgtcgacggcttgagcaagcttccacaagtctgcctgaatggtagtctgggctgcttcggctgagggaggagtgaagctgtccttggtcgctgttgctgttgctgctgccggggcagcttgctgactagcaccctttagcaagcacgtccgtcgcgcctccaacacccgaaggcgggctgcgatggcctctgcgtccatgccaccctctgcttgggcgtacgctgtgaatgaattgatgggaacatacaagcagcccctcggacgatgagcggcgacaacaagggaacgggtcatggtttaatttctcctcatttcttagcgagaggggcgacgctggtgggttgttggcgaggcgctgccagtgatggaagcttatgggggagttatgcacgacactagtattgattcaaaccaacgacgcataaagtttacatatcctgccactctttttcgtatctttcgaagtctttggcacttttcatgtgggtgtgcccgaaaccataacgcttttaacctcctccccctccttcctatacagcccgctctccctccctgcttctagccttacacgcacgtttttcggcgtctgcgggggttgctggcaatg

SEQ ID NO: 8512 - DNA, 700 bp, Nannochloropsis_gaditana
  misc_feature (1)..(216): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggaggagaagggtttgaagcagaaaagggcatcgaagcagttccacaggcctttttattgtgagaatttgcgagggaatgcacagaagtgcggggaaattcggccagaaaaagcgcccgaggggaagctcccagtggtagggctgaaagttgaagcacgctgagggagatgaccagcgcagcagctaacatgaaaaagtggcaagtttcgagcgccacaacaaaacgacccaaccgatgggaagaggccgtcaatgctgtgtgaaggatgcgaacgcaggcatgggaggcttgtgaatgtctgggaaggtctggcagtcgacgctcgctgagagacacgacatagacctggcaacctcccgtcccaagaatgcgtgacgcgcgcgccgtgcctcatacaacgcagcccccgaatctgcttctacaagcacaggtgtctcacgtgaggaaacaccctcggctcactctgtggtcggactcatg

SEQ ID NO: 8513 - DNA, 700 bp, Nannochloropsis_gaditana
tcaagccatctttcttacccatcacccagcacatttgcatcaaaattttgaagaaagcttacgagtctgcagactctcagctacttcaccgtgaagccatggtttatccccctgtgcactcggtgacgggtgggtgccttttctctttattttatgtagcactgaggaaaacagcgaggtgggaaaagcaacgagcctcataacacctgttctttctctttcttctttcatatttgcgtccaccttccatgactcttttatcctgtgtcgatgatttttttcctatctagaacgctgacatcatcgtgacgaagttgcgtatgcgagtgccatctttttctctgccatcggatcgtcattacggctcctgctgttgcgttttataaaaacacttgcaacagggccagagctgttctaaccccggaactccgtcaaaaatctcgaactttatttaaaatgtctgcatgtattctctgcttttgtcgctcttttttccatcgtttccctcgcatcatgcattgcttacaaagcgggcaaattttacgagatttcgtcctcatcttcctccaatttctattttcccgtcccatttgtcccatcaggatctaggagacaacgtatctgcttcctcatctgatttcacaacggctttccaggcctttatacgcctttgtggaaaaccttcggggcctggtgtatg

SEQ ID NO: 8514 - DNA, 700 bp, Nannochloropsis_gaditana
cttgtttccctggaagcaaaccatgggatctgcaccattcaggaggtgtctgttcttttgacgcgcgtcttttgtggtttgcctttctatagagccattctgacacctatcacacacgtagcatattttacatgctgctgcatcgctctgatcgtgtggaatgtgtcaccgggctagaatttacatgtgagaccggatggccgcgaaacgctttcgtgggccacgagccattcgtcggaggtggtggtgatgtgccgcagttgatggccttctattgggacgtgggtctttcttcagttccacttgcacataagtatgctcgctttttgtagggcgttgcgtgtcaaaagattttttgggcctctactttttggtaggctcgggaacgccgcccttgggggcgagctggcgggattctgtggtgatccgcttggctctcatcacttcgagagttctcaaacggatgcgcatcagtcacgcacactcgatgactaacttgccctacactttatatttaaatcaactggggtacatgtgtgattcagccgtgcatgatttgcggcctccgtcgcggagattctcttaggagagggagccactagggaagacgattttaaacccgtctcacatctcctcttttaatattttgtttgaaacacagacttaaccactccctgcctactgtgatcctctcgccatg

SEQ ID NO: 8515 - DNA, 700 bp, Nannochloropsis_gaditana
gggcctcttatcttacaggggcacatgctttcctaccgcgtgaggtacggtccgattttcactttgttatccgcgcgtgtcgtccggcgtcttttttactatgaatacctcatccttcgatactgtcatgacgtattggaaagacctgaactgcaccgcgatgcgacgcaaggcctccccgtgatgcaaaggggctttcaagattaagcccgtgtcgagcagtatttgatagagagtgtgggcagcctccgaccccaaaggcgtatccatttgccctgtttgcgaaagaatagctcctgtgtccagtctaagtgacgctgtacccaactgatttggcactgtctccagatcaggccgcatattccagacggggtctgtaaggtggggggaggaggtcgggctcgactgggggagtgtacgtcgacaaaggcgaggaagagagatcagaagacgaatgcttgcacaagtgcacgtgtgaacgttgtagacacgtggcattaaatttaacggagaacattcggaagaagtgtccaaggacctcgacttgaaagaaagcccgctgagctggactgaggctttaggaacgtactccttcaaaatgttctactgctctttcttccaaaatttccaggaacaacagtgtgaaaaacttgctagcaacactactcggcaccagtaatttgcctagtacagtgaaatg

SEQ ID NO: 8516 - DNA, 700 bp, Nannochloropsis_gaditana
cctcgggtgggctcaagggagacgggggcctcggggggtgcttgggagtccggcgcgtcgtgggcggggggaagggcggggaggtagggttgggcaaaagggtcataggcctcccctgtaccagacgtgtcctcattcatccctagaatacgtgccagggtgtcctgctggtattttcatcaagacgaaaggatgcgttaggacagtgcgtgaaaaagcccaccggttgattattttcttgtgaactctttctgatcctccattttctcggcttcattgaaccgcagtctgcaaaaaagcctgcgagatgctctgatgacagtgcacagtgtttataaacactgcgtcgtgcgcaaaggcagtcgaccttgtgtgtagaatacctcttcatacctcatcctcacaaagataaccaagaaggaggctcgccaaaggcaagcgagggcaacgaaaacgagtcggcgtggggggttatacccattgtacaggtccatttcaacacgttgcaaatgttttgcatgttttgcttggcgcagcatggtacaaattgcctgctactcccaaaataaatagtaaaatttagaaaacaatgcaaaaacgatgggcatagcggacgtataggatcaccatcgttttcggtccttgacctctccctcctctgcactatcattttcaatacatccaaatccgcggtaggatg

SEQ ID NO: 8517 - DNA, 700 bp, Nannochloropsis_gaditana
  misc_feature (646)..(655): n is a, c, g, or t
tgtctttctgtcgcagcacacttgggctcaccctcgatctccttgtcgcagtccctctggggacatctggaagagccgagtcagagtacgaccttctccttcccactgccgttctctcgaaacctttctttcccctgttgccacactaccatgggaggactcttgcactctgctttgcggacacgggcgagggagggagaggggttggttgctttgcgtcttcagtctctctgagtgactcaactgcattggtacgttgtccctttttctgcaaaagctccgtcgtcggcaaggttgggaggtgagaaatctcaaagaaatcgccgcttctgctgctatggcggctgttatctctgctccgacttgagctcaggctactgccactgctgcttcgagggccgctcacccctggagatagcggggggagttgagagagcacggggcgagcacccactgtcgccgaggcggggtatgcaggcgatgcccggtcctctccttcgcccttcccatcggccccttccatgccaccttcgtctcctccgagcgatccagccccgcactcccacaggcggcgcgaagcagtggtcaatgccggtgttttgggttccaggggcggtaaatggacggtccgcttatgttccagcannnnnnnnnncccctggaaggcgtcaagtccctctcgaagcacatcctcaagatg

SEQ ID NO: 8518 - DNA, 700 bp, Nannochloropsis_gaditana
catctacggcctgatgagcgacacattgcccatcatgggcttcaagcgcagcccctacatcattttggcgggcggtctgggcgtcaccgcctggctgaccctcgcgctcctgcgacgaccatcctttaacctctccgccttcctcatcctcctcgccaactacagcatcgcctcccccgacgtgatcatcgacgctgctatcaccgagcggtcgcagctcgcgcccatgtatgcctccgacctccagtccctctcctggggcagccattctctgggcgggatcctcggctgctccaccgtcggccaagcacaggcgcacttgcactcccgcggcgtgttcgccctgacctctctcacctccctctccatcctgatcctggcctccttgcgctggctcccggagaaacaaatccctcggggccccgagcgttccaacgcctgccgcctggcctggcataaaggggggcaacgctccctttacctcctcgcctttttcgtggccttgtgcgccgtatttctcgccaccaccatcaaccacatcgaaaatcggctgaccgggggctacatcactatcgccgtcgccgtcattgtcaccgccgtcgtctacaccaccctcgggcgaatatccccgaaaattgcccgacctgccatatatttctttctgcgcgaggccctgcaacccaacatcgcagaggccatg

SEQ ID NO: 8519 - DNA, 700 bp, Nannochloropsis_gaditana
gctggacctccacgctcagaccctgcagaagactcacggcccgatttcgtccctcccagaagctcttggtgatgcgggtcttttcttgccgagcctcatccagttcctccgatttaagggcgagcgcattcttgagttgcaaacactcctgctcgtacatcaagcgccgaatgcggtccaattcccattcttgcggcaaggtgagcgcccgcacccccgaatttaaaggaccttcggtggagcggattgaccgcgtcgaggcaccactacccaatttactgggaggcgacgccagcatgcctgtgagtatcgaggaggtgtgagagcggggacatgggggtgttgcacagagaggcatgtgggatggattgcatcgacccgtgggccgcgcccgctttgctccttctcggtgtgtttaaatgctggactctccgtacagcaaattgcgtccatgcccttgaggcgctcgacgcaatgctaaaagcatgcgtcgcaaaaatgagggaagtgacgacccgacacgtcggaacatcaaatggcaatgatgaggaaggtgaggtgaagatgcagcacacgcaggaggggaagagctaagaattcacgcagtccaatctacatcccgtgagcaccgacaggcattactctgtccctgcctcgagacgttaaattcagcatagacagcatgcgaaagcctaccatg

SEQ ID NO: 8520 - DNA, 700 bp, Nannochloropsis_gaditana
  misc_feature (1)..(655): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacggcctgctgggccccaacaactgcgggaagacgacgctgatg

SEQ ID NO: 8521 - DNA, 700 bp, Nannochloropsis_gaditana
ccgcctgcgcgctcaccaggccaataccatgtcccatgagccccaagcctaccacacccacttttttgatgtcgtagtgtggcgtagcagcaagcgtccgacgttgttggacgtgacaccgtcgcggctcatcaggcttgaggctgagacgaggaggggcgcccaaggcggagagatgacggcttctataataccttcccatccccttggagatcggggagaagaaaaaagaggacagccgcacgtatgataacatagcactaatggagggcgacactgtggatggattccggaggtcatgaaaagtgaggagttatcgctgcttgtatttctcctctcgcgctgcttcctctttgtcttccgccgcaaaatgtatgccctcacacgtggagtcccggtatgcgtgacccactcggtgccagacgcaacatactttcccctcgcgcccacgaccgccacaaccaccattaatgggcgcttttccaaggccgcatgccttgacttgagggaaagcgcggtccatcgcccacaaattgactttctgagcgatgccacatcgaggagaaggaaagggcgctagacgcacattttgtggtcatttaaggtcctttctctcccccacatgcgatcacatctggtaataatacattgatttcactctcacagtgatcccggtgtgattttttcccgcggggggatg

SEQ ID NO: 8522 - DNA, 700 bp, Nannochloropsis_gaditana
cactgggctgagtttggccacgatatccgcgtcgttcgcaggggccttcacgcagcatgccatggccagaaactctcgctgcgccccccaagcgtccttgacgacctcactcagctccaccgcctgcccgcctagctttgcagctgactccaggaaaggatgaagagtggctttgaggtattcgtcgtaagtggcgagttcgatggcttgtgagggcagcaccggggcactagagctttccggtgtactcttgccaggacttccaccctcaaggatgcgaagacgctcggtaatattagctagtaaagaggagagatatgcatgctcgtcagcctgtgtcgacatcttgggctgcaaacgcgtgggaatgggtttctgtgacaggaaagagggcggtatgggagttagtcggttacgagccaggttcaatcgaaagttggcgaggtcagataccgcgacaccaaaatacgcgtcgcgtgcggtcgcacactgccaacccttcccacctcttacacacgcaccatggttccgagagtgtgggagacattgtcgatcaggactcaggaaagacaaaaaggcctctttctcccccttttcttctgtagcagagttgacttggcgagggtggctgagatgccttcgtcattgtgtaaacgtggccgtacgcaaagtgcattcatactaacaccgcatatccact

SEQ ID NO: 8523 - DNA, 700 bp, Nannochloropsis_gaditana
aaccatacctaacggcaggacgacaaaggatggagcgggccagcatactgtgggtagatgtgtgcaaggtgaaaagaaaaagaaattgtatgaacaagatacgacgaacaggactggaaatgatggccgagcaataggcgagtacatcatacaacgcacctcctctccttctgatacgcactctcttaaagacatggtggccttggacatggccggcatgttgcaccgaatatgtcatgcgttcagcgacgtctccccatgcagcagtgcaggaacagcgagggcattcaaacggaatattgagccatgtgcaatgcccctacctcttcttgccttttcctccttcgcaaggaggcggacatcaggtccccacgaatcggggaggtttcaattgtctcgccacgctggttggaagtctttttcccccttggtgtgctgacgattataaagtgtccagagtagcagtaaagccggcaggcctggccttcgcctgagttcctagctctcgcccgtggtcctggcccctccctttcccggcgcccccccttccttattgccactttacttaaaggcgctctcactgcaatcacgacacagcaagccttccctatcgagcgtcatgggcgattccacgggttcaaaagatcgccaacgcccaactttgaggtcgacatgcccgcctttcataccttcaaggatg

SEQ ID NO: 8524 - DNA, 700 bp, Nannochloropsis_gaditana
gggcaaggggggatgtcacataagccaggcgacaactataacagcagcacaagagcgtcagccatgccaaaaggctccccacgtgcatggcctaagaatgcggaagggaatggatcgagcagaagggagttgattgctagctaagtggatgaactcatagtctcgttgctttaacaagtggagggcggctctgcgtgcactgacgggcatgcgtgcttccacacgagaaacgagacgcttcgaattttagaagccccaggcgtgtgcaaggcctggcaatcctcggcggaggcaaggatcgagtgccccgttcgacttggccactgtgtgtcggtttggtgacatgaacttgaaatcgccgaagggggggggtaggggggaaaacccgggttccgctctctgtcctgccattgcgtgtctgacccccaatatctatcaagtacacagacctggtcgacagtgggacggtaactcgtgcgctctgggagtctttgtgatggtcgtgactcaacaatgatgtttcacaagaaccttttccactgccggcacatcgtggaacaggttctggtgtcaagtcttgggcgtacatagggcaccaaaaatgtactgtcgcccgctacggtacattttaagccagcatgcatttgccatacagtcacagagggggctgcgtaggctgaatttatcagccgcagggatg

SEQ ID NO: 8525 - DNA, 700 bp, Nannochloropsis_gaditana
aggaaatgagtacgtcctgaggggacaaccccgtaagaggaagaaaggcgatctcagaaatggtgtctgccacatccatgtacagccgtctgagacagggacaagacgccagcaatatacgcacttacacgcttgtcagatcatcatactcttcggacgggggagcaatgatacgcaaacctcgtccaatttccctcatactggtgtgacttgaaagcactatagcatcaaaatgtcctcacctcatctgattttctgctgccgcctccgccatctccacgccgccgatggtgcatagcaggtatatctgtcctgatgcgcggtcagtggcgttaaagtaagtctcgagtgccggaaggaaacgttggtcatcttagtattgcaatcttggcgagggagtgactcgccgcaccgactcccgtgataacagtgtccagactgattatggcataattgcaggcaacggtcagagtgtttggtccatgccgtaggttgatgtctatattcatggctatatccacggcatgcatgcgtaggactcagcgtccaggtagcagcattgtgagctgcgacagatcgttcacccccgtgttgcatcaagcgacgctttctcctactactagtaggattctaacaactcttcgatctgccacacacacgctcggacacacgtcccttagtccctcctccactcatcatg

SEQ ID NO: 8526 - DNA, 700 bp, Nannochloropsis_gaditana; identical to SEQ ID NO: 6068

SEQ ID NO: 8527 - DNA, 700 bp, Nannochloropsis_gaditana
tatgctacaggcatcttaccgggtgggagtccacagcggccaagtgatgcagatcgtagagaaggtcatctggtttgtccttatgagcgctattggcgccgttgtacgccccaggggcaacgtcgacggctttaactaccgtggccgcagtggcacgcatgaggccctgccaaagtgttgtgtggcgggcggcttgagtgctggcaaaagataaaaccaaaaacgaaatctcgcgccatgacgacgcacccttttccatacattccactactacacactctatagatggtcccatggtagtgactcgacaaatgtatgccatttaatcgcgggcctgggcccgggggggaggccggcgtcggacaggcggctggccgttgtctttcccggctatctctaacccggaccccttttcttgaccaaaataccgcctgtcatgcacatccttggtctgcaacacacacgaagctgcaagctaacgcgtttgatactgcacggaaactgcttgggctgcgcggagtcaagcaaaggaaaggcatgtggtccggcccaggcgggtagagacgcatgtcgtcatctgcaggaccgtcataattgaagttctttaattggaaaccttccattgcttttcgcaacacacaggccacgaaatcgggacgtactctctagggcgcaagggaagtacacggcctgcttaatg

SEQ ID NO: 8528 - DNA, 700 bp, Nannochloropsis_gaditana
agaggtgagaggagaccttccgacgacgaggtgaatgaggatacgggctgaggaaggaaagccttgaatgtggcacgaatatccgcacaaatacgcggtgccgtgtaaaaagggcaccgccacgtcgtcctagttgtggacgtcaaatttcgggactgaatacgggggaatcttcggcatcccacgattatgtgacatggtttgcagtcgtattggctcgtctcggttcgcccccctcgcttattacatgcagcaggactcttagcgaagatggccacacgaaatacattttaagacgattgagggccgtggatggcgcgtcttcaagcatgacatcgtgggttacattcagaggtgccgttgactcacgtctctgtgatctgtacgtttttcaatcgatgatggaggagcctttctcagtgaactcaatgagttctggcatgaaatattgacgcagtcgggtgagggatggcgacggctctcaggaaatattgagagcttgactgcttgtcaacgatactgattccaacgcattgtgaagtgccatagagtgcggcattaaactttgggttgaggtcgttgccctttttcccttgttctttgcaattctcaggaaggggaaagaccatgctcatcctaaatacttttattcacattcctactatttcgatgacaatcatgaacagggctgcatgtcatg

SEQ ID NO: 8529 - DNA, 700 bp, Nannochloropsis_gaditana
  misc_feature (34)..(43): n is a, c, g, or t
tcacgcctccttccttggcttccatcgcttgccnnnnnnnnnngggagggaagaagggtgggtgaggggcttactcgggggattgatggactactgattgtgtgggaagagggaagaagggagggaaggagggagggagggaaggagggagggggagagagggagcttaccgtcatagacactgctgttcatctgatcgtccattcccagctgtacgtgaaggatgcgaaaacgagaccctgctgagtgccctcgaccttcccctcctctttttcctcctcctccttcctcccttccgtcttacctccttctcagagcgcaggtcgatcaaggttttgaatttggccgtttctcgaatgaatttgatctgcggggggacagacggaggacggaaagaaatggaggagaaagggagggagggaaagcatacgatataaaaaggttacggcgcctgactcattgttgcatcgcacggatacatgataggctcacatggctcctgtcacgtggtatcgggccctttcttccctccctccctcccgccctcctcctttccctcctactacgcacgtcttcctccgaagccttgctcaggtatcctgtgcgataaatgcgtcccgctttaatcccggacccacgcacggaggataggtcacggatgtttttcactcgttccagtttgatcccccctgtcaccatg

SEQ ID NO: 8530 - DNA, 700 bp, Nannochloropsis_gaditana
cactgtcgtcggtcgaggaggaggtggtggtctctgattcatgtcccttcccgacgtgctccccccgttcctccaccggcattcccgcttccttctcgtgccaggacaccctctccaaggactcctcctcctcctcctcctcactcgaaggttctatgttggctcgacttcgaatacgttgcatgtacgcgtcttcttctcctcgttttgttcctttctttcccggtgtatcctcccttttacctcccctccctccagccggaaccttgcccggccatccccctccccgggatcggtttcgcatgctgccaaaacggacctgtccctgcatgccgcttgaattttttatttgcacatgtagctttgttgcgtgatactgtctaggcctatgttatacgaggccgtgagtcggtatggtatcggcgtgagcacgagggagctttgtaagaggttggcgacagggtctggttactgtgcgaggagagcacatcctaaggagaaaactttgacacaggcatcatgaaactcataagccccttgcaaggtgatcgcattcaatgtgtccattcattcacgttcatccatttgcaataggcagagcccaaattttgtcagcaagtcaaacttgggagcgccctcgacgtgcgccgcccccccccgccgcatccttcctcccgtcccagaggccacaaaatccatg

SEQ ID NO: 8531 - DNA, 700 bp, Nannochloropsis_gaditana
aagccattgcgttctccatacggtgggattaccttcttgcctgaaatctgcgagcatgaggtggtagaagagggatcagatatgagtgtgaaaacagcacatgtctcccccgctgtaatgcttcctcgccacttcgtaaagcctaagcccgtcatactccgggcagactttcgcccttacctcgaggcgcgccagggcggtgggggacgggtcgtctttatggacttgataagtctgggtgggtttgggcaaaagccttgaaagccccagggtggccattgtacctaggtggccagatgaacttgatctgttacactgacagctctgaatgcgcggccctgtctcgtattcgtgtccatggttgtagttagtaagtagcatgtgttggaattaggcgtgagaggccgtagctaggcaccaatgtgtgctatcttcaccttcggcgtctgccgtagcatgcggctaccaacacgttccacccgtagtatcatgaatgaggtgatgccacagtaagatggagcatccgagcgtagggcatacatgatcaggcacgcgggaaaagaaagggaagagtcatcccctcggagtccaggcatcttcgcctcggctttacgcccttcttcgaccgcaagctttcactcccagccatcagcacgacaccatggctatttcacatgccatcacttcttaggaacttgtt

SEQ ID NO: 8532 - DNA, 700 bp, Nannochloropsis_gaditana
  misc_feature (445)..(454): n is a, c, g, or t
atgcccgaggagcgggatcctcgggtctaggtgccagaaatgggcccaccgtgaacggccggggaaggagtgcgcctcccggtcatcggggagggcggagtggcggcaggggagggggcggctcgggcgttgtgatggtggggggtccagggcctgcctacagcaacagcgagagtcgatcgacgtccgtggggccaaaggcctcttccggcaacggaaccgctgggccgcctcggacgggggggcggaagcccggtccctccgaaatggctgaggcccccggcgatgccgccgaccccgccagggccacggggagaccgggggccttgccaggcggagaggccccttgggaccagcccgtgtcctcagtcttgtcgggcaagcctagcgctgcagttggcccctcttcgtcctccgccgccccctcgcccgcgtcggcttcgannnnnnnnnnaggggaggaggcgagaggcaggacctgtccagtgccagccctacgcgtgccggtgcagggaagagcgttgtggggtcaggtcaggaggagccgccgacgtcaccggtggagtggcggaaagctgcggctggaaagggaggcatggggagggaggaggaggaagagggagaagaagaagaggagggccctgttgaggtgcgtgtgcacagcaagccgctgacagaggaagaggcggagcaggacatg

SEQ ID NO: 8533 - DNA, 700 bp, Nannochloropsis_gaditana
ccttatcgaagtcatcgggggaggacgcttccactactgcctgctggcgaacgagctgaacccttgatgccctgctgctgtggacgggtggtgcaacgaaggcgtccgacgcagaaaggagtacggctccaagaaggaaaaagtaaagcaaggttctcgtcataattctttgctacgactggggaattttcactgcaacctccaacttttgcgggtcctggtggcaccttgcggtaaggtgaaggttgacggggtcggacaatggagagatgcatgaggacgaggtacggggggaaaaaatcaaggccggcgaagcacacctctcagtcccaaaggtcaggatctccgagtcgctgtctcgcgttcactcccagcttgagcctgcggcgtgtgcggcagcgtggatctaattgcaaggcgccggggggccgcattctctcatttcacccctcgaggcgagtcgcagcgacgccctaaagaacactcgagaaggaccgcgaggttctcgcggtcgctttggggtgggagcaggccgcatgtgagcggtgttgcacgtgtgcacaaaaaccggacccacggtatcacatcgtcctcatgttttttaaaacgcgtacaatttcaagttgtttcacccagcaggaaaaaccacgtactagccagacctcccccactccatccactacctagtcagacagacatg

SEQ ID NO: 8534 - DNA, 700 bp, Nannochloropsis_gaditana; identical to SEQ ID NO: 4880

SEQ ID NO: 8535 - DNA, 700 bp, Nannochloropsis_gaditana
cggtgggcatgagatgacagttttgggtcaaaataactcgtgagaagaccgaaaggtgcctcatcttcgcaaaaatagagagctcgtaaaaactacgtcggatatagaaggggcgattgagcacggggtacgacatgctcgacatccgagtcttgggctgcacttgttgcttttcagttaaataaagccgaattagggtgaagggtcaatcccatacgtgttgctttccccagtactaaagaagtaattatgtacgtctaagtgatcatctaagcccgacaaacgcgaaggtgcctgtgaaaatgcgtgactgagcaggggattgccgcggggaaagtaacgaatccggcgggaggagcgagctgtgctaccgacccgtccacaagtaccagccccagcctccgtcaaatcgaaccattataccattcacgcgagaaggcgccccccttcttggtcttggcatgaaatttgggcacgccacgcgcaagaatagtttactctgccaggcaatcgatgcgttggcattgccactaataagattaaccacgtagtatcattaccatcccaaaatcacttattcagaaaggcgcatctgttgagctaatcaccacgcatttgagacaaagttgcactggcgcccgtgtgaggttggcaatatcctccgtggtggccaagctacaaaaaagcgccggttcccatg

SEQ ID NO: 8536 - DNA, 700 bp, Nannochloropsis_gaditana
ggcgaaaaagaggtttaagatgacctcttttgtgaattagggttctctcttaccgaagtgttcctgtcgtgcttgtgctgcataaaaatgagaaagtttgagaacagatcccaccaaattcagttgaattcgtgtacatagtcacggaggcctgcacgattttcatcagccgctcacatgtaaatgtctcctgtttagcctctcgatcttcttcaattgtccatgtacggtttgaaaaagatatagcatgagtcttaactcgcaggtcccatttaaatgtattaatttgggactcgatcagcgttacgctaatgggccggcaacatgtcatggtctttcgactgccccatctctatgtcacctccagagggggccgttgattgcaaaaaaaaaagagctcaatttgagacaggtgtaagctttgcaatcgactcccacttggcagcgacctaataagggcggggagagtggtgatgtctaaattcacgttttgcaggcatgcccatttcggtgcccctcgatgacgctacccccgccgcggcggccccctccacttgcgctcaactcccttcaggtcacagagtttcacaaaaaggggctcacaacgacagaaacacgatggatctcgctgtgggccaacagcctagcaacagtttggcgtacacgaatcggtgagtcccttaataattctgcagacatg

SEQ ID NO: 8537 - DNA, 700 bp, Nannochloropsis_gaditana
tgatcggcttcacggtaaccaccgcgcttggaaactttctccgcaaccatggtggatgcctgatggaggaggaaggggaggagatgagatggagaaaacagagcaatgggtatcaacgcactccggcgtggggggttaggctgtcgtgcacctcttttagacttctataccactccaatcatgccgctggaatttcctcgaaagtataattctggattactgaacaagacgggcatgacggtaccgctcgtctcgtcgaaagcggtagcgccccacaaggagagcatcttcatcgccattcgtgtgtcaacgaaagatagagtcacacagaattcgaaagaaacatattacagagcatgctaagggagaatgacgcgtccatgaggccacagaggcacggggcagggcgggaggaaagaagggtggctgggtggctggctggcaggctcggagggccgcaggatgaggtctcccgcccccgccgacatggcccccccgtgcccctgccaacactgcggcctttctggcactagggacaggcggggtgacccggcctgccgcatgtctcttatgtcttcgagcatgtctgaaggactctgtgaatattctttcaggggtcgtcacaacggtgcacacaagatttcaccattaacctcccccctctcgggtgttcccacagttcgtcgtacagattaccatg

SEQ ID NO: 8538 - DNA, 71 bp, Nannochloropsis_gaditana
cgaatccaagtgacgtgctgcccgaggggggggggggagaagacgggcccctgctcataatgcccaccatg

SEQ ID NO: 8539 - DNA, 700 bp, Nannochloropsis_gaditana
cctcctgtactgccaaacgaccttttaccgccgactgcaaccagacgagcgagaggcgatcgactcgcacttctgtttttttccttgaacgacaagtctgccaacgacgcttagactctacctgtcaatctagacagagtcattatcggattctagcttcaaaccacggccttttgaccagtattgctgggaaattgctgtcgtgctgaattgcgtccattcctgtagctaagctaagagtatcatgcatcctgggagtcgatgttggagtgatcgtcataagtaccagctgtcctgacatacccacatttctaacgctccttctcattttcttccgtttgtccatggcatcactaccatccacattggtgcaagcccacaggacgataagtggtaattctgggtgtagtcacgcggcacatgtctcttcacttcacgactgagcagcatgccagactcctctaattcctaagcattgtgtcacctttggcgccatagtcgctgcattgccttgcgttcttattgtacatctgcaggtcttgtctggatgtatgcatgctaaagcgcttgcgatatttgttcctcgcgtatcctggccgtgccggctggtgactcccgacgcctcgagtagccgtccggggcgagacttgatttccgaggctcaaagaaacaaggcgaaagagatacaaatacaagcatg

SEQ ID NO: 8540 - DNA, 700 bp, Nannochloropsis_gaditana; identical to SEQ ID NO: 5112

SEQ ID NO: 8541 - DNA, 700 bp, Nannochloropsis_gaditana; identical to SEQ ID NO: 5113

SEQ ID NO: 8542 - DNA, 700 bp, Nannochloropsis_gaditana; identical to SEQ ID NO: 5116

SEQ ID NO: 8543 - DNA, 700 bp, Nannochloropsis_gaditana; identical to SEQ ID NO: 4499

SEQ ID NO: 8544 - DNA, 700 bp, Nannochloropsis_gaditana
gcgtgtcaaaaactgcatgtgcgactctcgttcgaaatcctgtccgggaaaaggggcgttggagtaagtctcgtggtcgcggaaatagaacattcacttggaagactctggggaaagagcgtcagagcagagatgtcaagttacctcccgcatgccattcgatagctcgaaatatcgaagtttttttccataaaaataaatactaatcgatgtttttcaagtactctgtaggccaacatttttcattcttactttgtgtcgcagctttgttcctttttctgcggacttcgcgtcctgtactcgcatgtagttctcacaccgtcaaggccgattcagtgatggagcgacagggatgatattgccgtagagtttcccatgggacgacgactttgatcggtaaaagctcgtctttggtcataccgtcagtgacttcccaccttcattcatccaaacgttactcgaaccacgttgtttctggccacttctccttcacatgctcatgaccaccgatagcctctctatccacttcaccggtgtgaaacttcctgttcgccttttccctaaatttaacttcataatcttcttggcgagtcgacgcatgcgtgcctctgcttctcgtgtgccgggcccgccacacctttcccggcgttttcctttcctcctcccccccctccccatcggggagggccaccaccaaatg

SEQ ID NO: 8545 - DNA, 700 bp, Nannochloropsis_gaditana
gcttgctgtgacctccgctaccaccgctcaaagagtcaatccttccggtgcgctagggcgggcggaaagaaggaggggatgtctccttcgtccacaggcacctgcctacactaaaggccgccagggctgatgttgttcgggttgaccttcgagtcaatgacctgtgtacgagaaatcaaagggatatgggacggtagagtgtaagtcaacgactgtgggccgtgaatcgccttgaggcatgacgtcgcagcgttgcccacagccaggcagggaatcaaaactagccaaaaagtctgcaaacacatgccagtcaacaaactggacaagaggacaccaagcccattccctctctcttaaacgcctccgtcattgaagtcaacttcgtgcgcttgacgcgctggcggcttagacggacgtgaagcatggcgaaggatcgacgtcccgacacgatttttggaggggaagaagcggataaggccagagggcgccagcggcccgggctagcaccttctagcgcggtcattttggggcacgatgttttccagccacgctttcgtgtgcaactgacagaaacattatgaggtatttttctacgttggatttttgaagggaggtcttggtgttaatgcatagattttaaattcagactaggagttccgttttgccacccccacaggagacgtagtatccacacagcatg

SEQ ID NO: 8546 - DNA, 97 bp, Nannochloropsis_gaditana
agtaggggcggcgccccgcgtggggaaggtgttgaaagaggcgctagggacagaaacgcatgtcttagcttccgccagcctcctgaacgccctcatg

SEQ ID NO: 8547 - DNA, 700 bp, Nannochloropsis_gaditana
gtgctcgcgcgtcagcaggttaatccgatcgtgtttgatgagcgaggcatgacgctcgcgggcgagccgtgcttaagccgcaacgcccaggccgcggtcgcaccgaggtcagatgcggaggccggcgcttgggtcttaaacaatcacaacgaaatgcgatctgaatgcctggagcggtcgtcggctctctggagcgacctcttggatcagggtgagcgcgatgctgtcttcgtactcattcaagcgcgcaggaattgggaggcggttcattgcgaccgcctgcaatttgcatcgaagaggccagaagaccgcgctgctgccgtcaggccaggtacggtcattttacgattgcgaaacgccaataaccctgcaggcgcgttctccctttatcagcaattggtccggggtgtggacgaaattgcctatgatgcaccttgggaggctgtgtgtggtttcttcggcacaacaccggttgaccctcaccttcttgatgaacgctacgcgcttttccaagagattgccgatctttactatcgtggcccctcatttgttgtagacggtgcgcgaatgacgcgcggaacgatctcaattgcggaccagcgtacgtccaaccttgagctttgggacctcgccgaccgcctcccatacgatgacgacggggccaagcgcctgactgaaagcgagtcgatataccggcatg

SEQ ID NO: 8548 - DNA, 700 bp, Nannochloropsis_gaditana
cgctggagggatgacaacagtatctttccttcccacccgccgcatgtgtgtctatggccgtagtgctcctttctccactcgctcgctccctttggagagctgtgttacacttgagaaagcacagccatgccggtctgaggggccgtgtacggtgtggctacgcgtggacgttgtgattttgggggacatacacatgcccgcggggctctgagagaactctgcagttgagacaaccagtgaatgcttagggaatgcacttttgccggaaaggacgtgccccccacctagcgacgggacgtggcacaggcgaggtggccgccgcttaaaggaagccctctcgctttccagttgttggagaaagcctcactgaatgtgtccccatgtttgagttgttacgcttgtgtgtcgcgtttaccgggactccactggtcgtcaggcccgaaagaacatccgatgccgcctcacttcccatggacttaaaccaccctctcccctcccactctccaaccctccttccacctctcaggagactacacacacgtctcagtgtcaggtgcacgtggtaaatccacttggaaaggtgtacatcgaacgacagggaggaagcggccagtgagagcagtccttcccccagcgtctaccaccttacgcgctgctttttaaggtctcgatggccggacgaagcgccaagtacagcatg

SEQ ID NO: 8549 - DNA, 700 bp, Nannochloropsis_gaditana
gcagacagcgtgcattaaaaaatggaaattttccgaagcaagaaaatgggggatgccgaccaaatgtgctcctaccatggcgaatgtgatgtattccattgtcatgagctcatatgcgccacatgttgaggcgagtgaatatcattttcgcgtcgagctactcgtagacggtctgacactccctcccgtcgtctgtattgcaacgtgaagtcctgtatcaccgctttctctcctcccgtatgtgcttgccccacatgtaactataacttcatgacaatatggatgtttgtaatgaccactgggctgcgggagcatagcacatacggggcaactcccgtggtggtacgggaggttgttgacattgcggcgttgctgaacgattgtttgtgtcaattctggccgcatgtcttggagaaggaaagtgcatttgttggaaattacatggaaatttggacagacagtgggcttttggtgtgtttttctgtctttcgcatctttatttctgtagtcaaggctgcataaggcggtgataaacaagccctcacctctgataccagctatgtaacccgatcgctccatgcatcgacaaactgacattgtattcatataggccaaaatcttcgaacagtcctcttcgattgtttttccttccacctgcagcatttgttcacacgtggcattggctaccattctttcgaca

SEQ ID NO: 8550 - DNA, 700 bp, Nannochloropsis_gaditana; identical to SEQ ID NO: 5522

SEQ ID NO: 8551 - DNA, 700 bp, Nannochloropsis_gaditana; identical to SEQ ID NO: 5526

SEQ ID NO: 8552 - DNA, 700 bp, Nannochloropsis_gaditana
tatagatgacttggagaaatacgaggtaagggccgccatcgacgagcaagagtttacacaataacatcaaaaactaagcacatttgtgagcaagtactgggaattgtgacttggttgcattaaattcaagtttctccacattgatgtcgtgcttttcaagtattcactcttcacaaaaaccttttttcgtttggttgatctctgtattcacaagccaaattttcgttttctttccgtatttttaatcctttcatttgaatttattttaacatcgacgtgttggccgcaaaacttttttcagtccattatttctcaatgtccatccatccatcctgttcttatcctttttcttcccgatttttgctactcatttttcctcgtctacaagccctcacgagaatctcgacacagctactcgccttttctcttttctttacatacgtaaccattaattcccattgtctttctacgaaacgtattttagtggcgtcgtgtctccctacggacgtgccattcaaatggatggcgtcactccttcgtcgaattgctacttgtacctccccacccccttggacgcagcctctctgcacacgtttacaaaaccatttcctaacatgaatgcttcgttgtcacagataaaagctggccgttggcgccgatgctagcaaagggctccacaacgctttacatagtaagcttt

SEQ ID NO: 8553 - DNA, 700 bp, Nannochloropsis_gaditana
aaaaccggtgaagtacgaccatacagaggtaagctttgcgcgactctcactcgcaaccaataatcggtcagatgtccgattcacgccctgtatttttgaagtttgatttggattttcatagaatttatttcatttctgctacgacgcgctgtgcttcgcagagaagatttttgtttgttcagaggtgatgaccataagagcggcccatccgcacgagacggcaagcattctacagcccgatgccctcaggactatcgcatatgcactcccgccactcatatcatacgaatactgtgcagacagataaccggctagccaaattgtttttcaaaagcacggagcatgaatctacgatggacggaccggcctcagagaacaaatattccctgagcccagaaaccgccgggaaagtaacggttcaagggggatcccggcacccaaaataatgtcacatgacactttggagggcggcggtggtatcaaatgtccaatgcacgtatggctttgacactgatatggtgacgggttaggtgcttgtggcgtaatttcaggattcttccttggccggttgttgcgcatgcattcgcaacgaggcgctcgctcgttgtgcgaaatggaacactccgcgactcctcaccaagggaggaaaatatccacccacttccacgtgctgattgcatcacacatactaggcaacatg

SEQ ID NO: 8554 - DNA, 147 bp, Nannochloropsis_gaditana
aagagcggcccatccgcacgagacggcaagcattctacagcccgatgccctcaggatgtattcctctgatccagactacttgaacattttcttctcacttattattccaaccattttttcatacgacagcggagggacggaagcatg

SEQ ID NO: 8555 - DNA, 700 bp, Nannochloropsis_gaditana
gaagaggatggcacgtgggaggcggatcgggactgtgtcacccgaagggaacttgacatgatttgatagccttgtccttgatgaccccaatgaccatatatgccacgtatggcgaaatgtttgtagcgatgcattgtctgattgcaagtggttagcttgttctggacaaagtacaaatacttgataagagacagaacgttgatgtttgcctgtgggaaggaaaaaggaaaataagttcttgtctcaattcctggaataccgaatgcaatctcgcaagcaagacctcatgtccgtattgaaatttaagctatgaccaaattcaacactttgaaggtttatcgaccttttcatgtgagaaagaatgttcgcaaaatctcttgacaccttctccgaaataggattagctagaagggtaatgatgtcaagcatgattcaaaactgtacaaccaacgaaaagcgaaaaaagacaggataaatgacacaagcaaccccaagattaagaaaattcgagcgtgcccgcatgctcggagccccggtgggcccctttccggttccgggaaacagaacagtgtggctatgtagggcctggagttgaagtgcatgggaaaagtgcaacgcacgcgccggcaaaaacccgcgaggctgtccccgcccctttgccaagcgccttttctcccccatacaattgtacagtggcatg

SEQ ID NO: 8556 - DNA, 700 bp, Nannochloropsis_gaditana
gggcaaagatgccttgcacgtaccgcggcatgactcagagatgggacaccacgggccagcaaggttgtgcggggcttccctgcacgcttgtttgctttcttcggagccatagcgtctgtcaaggcacgtggaggatagggtttgaagaggggtggttatgggagtctgtttcttcattcgcatggcctctccttacagaaggcccctgatggaagaatcagtttggagaagcgcttacgacctccacaagaatgtcagtgagagtggcgaaggaagtagtgaacatttttccgaggcactgcgatttgtgagcggttcacgcaaactggagaagaagcagggagcttctctgccatcatctcaaccaccacacaattccccgccaggttacacgatccgctcctccgaccataccacagctcagcaccgaatccaagctctacaatgaaatgttctcactcctggcacgtttctggtcccctgtccccgcccaccaccgccacggagtgggcggagcgaggccaccacagccacagagcggggctggcgaagggaactagaatgatcgatcaggcgctaggcccacatgccgccgggcccgcggccccatgtcaacttgcctctttcactcacgtccttggtaattacagggatgatgtggaagccatgggagcgaaccaggcgtgactcgtgcgctatg

SEQ ID NO: 8557 - DNA, 700 bp, Nannochloropsis_gaditana
ttctttttactctcgtgccgacgagacttgccgctccccccgacgccgcgtctcgttccttgcctagagaccacgtgtctcggtctgcacgtcaccgggccacagcgcccgacgcacgcgcacttcatcgtacaccccaggtttatgcgacaaaaatgcgccgtgcgggtgacacggccgcgctggtttcgggcgccgggaggagcaggaaacctcggcgtgagagggccgatgtcagacctctcctcgctgcctatcgtcgcaggaggcagcactaagggcttgcaagataccaccccttccggggtgtcttacaaagcataccacgcggcgccccgaacatttttactattgtgggatcgagaaggatccctgcatgtgcacattttttcctcggccgttttgactgtctagatgtgatgaattggccccccacgccgttcatccagcaccatgaggtttaccaaattgtaggtcctcttggcatggacatagaaacatactgagacgggctccgtggggctccgtctacatgaaaccaagcataaggaattcgggcatcagcaaatggcgcctctagtcttcttggtcggagtatacttcttccatatggtaacaagcctcaccatacttgtagcccacagacccacatctccttctttttttgcaaatgataaaggctgaattctccaattcgatg

SEQ ID NO: 8558 - DNA, 700 bp, Nannochloropsis_gaditana
cccctttcctcttgcttctcatgggtaaggacggcgtctccctcgtggtgcgagcgctcgtcgcgctgacgcttcttcttcttcctacaaatacgcagaaagaactgaataagtatccaaaaacatggaccggaatgtagacaaagcgtaacattatatcacatccatacaccaaccacctacaacttcatcgtttattttcgaagcatcaatgcccgaatcaggtgcgtccaaatctgcaagggtctcccactagggagcggccatgtacgtacttgtcttttgtaggaagccctttcagcttcagcgctccgccgacaggcatgagaatgctgtagagtcgtgcaaggtgggtgtgtaacgtgtcaacacgggtcttattgtgacatttccggtgacaatcacggggcactatctcgaaccgagaacgggcgtcagctgctccaggccagcgacgtcgtgttcgaggtaaacgctactctccaacatggaacattttggcgctttcacttcctcccaacctctcagttcttgcgagccaagcataggcacagcaattggatagcataatttgtcctttgcgagtatctgagtgcacatctatcccatgcagagaggtcgaaatagaccattgtccaagcccgccgtggccccctgaaagcacatggagcttggaaagttgttcagtccttacacaatg

SEQ ID NO: 8559 - DNA, 700 bp, Nannochloropsis_gaditana
gaaaaaggatgtagcggtgagtataccgcggtcagagaccacacataaaccatcaaacgctctcgggaaagccagtttctggttcatcctgataggtgaccctgacatgcgaaatcagccacgaaagggcccagtggcctatcaattgacgcgatacctcaaaacccgacacagctgcacacgttctttcccttccagcaagtaattttgatgtgagtgtggtcgtacgctggtccacgccgtcctgtcggcgttgtggactcgctgatcccgcatcacttgccttgcggcgacgaccttctctgtagcctcagtaccacatggcaaaagaactgtggactttaaccctgtcattttcccttctctcgacgcgcacacactcgcatacccatccccttcaatcatatactcgttgatagcattccgtgggcaccttctgtttcctcgtacaccatcgtggcaccttggcgaaggcccatttgaagcctctttctggagcacgccgtctcttgagccaaacccgcatcgatataaaggcatgttctccctctgcatctccattctgctattctgttccctatcccgcaccgtggaagcgcgcgggtgtcaagtcagaaaccatgccgggcggcccgttgacttctattggatggacgttgtgaactgggggacctacattactcaaactcccgtgcccatg

SEQ ID NO: 8560 - DNA, 700 bp, Nannochloropsis_gaditana
  misc_feature (688)..(697): n is a, c, g, or t
ttccgctaggaggggttgggcggcccccagacatgcctgacgggcccaagagaccccacaatggccacgcatgtccgggcaaagcggacaaggaaggagaaagcgagtacgagaaacgcctgcgggcggacgagaaaggggaaggtgtggcgggcacgagagaggtcaagaaagaacgggagcgtcggccgatccaagcgacggcccgcgagttggaggcagctcgggacttgcaggcaaagacggggatggggatcgaggagggtttgacggccctccgagccaacaattttgaccccgagaaggccgtgatgtggtacgtggaggcgtcgcagcagggtgggatggagatggctctcgtccatcatgcctctatcgagagcgagcgcctaaacgacgaataccggcgcgcggaaatgcggaaacaggaggagctcatgaaggaaggagacgtgatagggagtgcaaaatttgccgcctccacgctcttggcggaagaggatggcagtagggccgtgcacgcctttctcaggcggtactgcagcagggggggtgggaggaggggccggtcgcggggacacgaggaggccagcgttgcgcggcgacgggagttggtggtcaagctcctgatcaaggagaaggaagccgtcagattctacaaggccgcggcgcatggctacatgaaggnnnnnnnnnngcc

SEQ ID NO: 8561 - DNA, 700 bp, Nannochloropsis_gaditana
agtcgtcgaagccgacgcccaacccgcggcaaacataagtacgggaagctgttgaagggcaagggcaacattaaagtctcggaaatgctgacataaattgagagaggaaaagagcagttcaagggagatggcaacgattagagaggagacaaatcattcaattgttaaacgaaatcaagctcttattgcagaaaagaagtgatttgtgttcttagtttttgtttggcattaatttctccttgcagactcagtcagtggataacaagcaacatgagacggatgccttctaacgccacgtttgctgccttgttgtctctggtaagataaccttgcatcccgagccacatagcttatgacaatgaagacggtcaagcagtgaaaccaaagctacaaagacactaagtcacgacccaaagcagcgacacacggtcagaaacgtgcccatggcgcgctttgtgagggggcagcgggggccaggaggtcgccgagcccctgcgtcaagtcgttgagcgggtatcgaccgtgtccgctcccgccaccccgctagcaccccattgcccggatgtgtacggacagcaacggtgctggtggctctctcattcggtcgatgaccgggtggcagtcgtgtgctacacagatgctcattttctcctcataacttcattgccaggatccctcttaccgctgcctagtcacgatg

SEQ ID NO: 8562 - DNA, 700 bp, Nannochloropsis_gaditana
tgacacaagcaatagctgtggccagaccaaggagggcgacgcctgtcagtagacttctgaagacatgcacagggcgggtcctcccctcattgacatggtgtggagcggccttcgatcgcacattagaatcttgcttaacaaacaaaggtaggggcatgaacttgcgctgttgtaatcgtgcacttgtaacgacgcaattttttggtcgaccaaaggcttgaaaggctgtgtagaggaagcaaagggatgcgaaaccattgaggtggggaggtggttgaaaattttcagttatggagcctgtctatgacttgtccttggaagactctgagcacacattgccgtcagcaattgtcggattttccattgaaataattggaaagcgtgtagccgcgtaccttctttcacacacggcgtggcgggacgtttacgaagggcgacggaacgctgagaggtaggaggggaaaacgaggaggctgcaaacaaggaaacaacgaggagataaattacgccatggcttgtcctgtgccaccaggagggcatgcacagcacctgtacgataggaatgtgagaccaggctacagaaaggcgcgcggttgcagaacccacatcacggcagcgaggggtcgcatcccatcgcccagatccccactgggtcaaattttcttcggcgtgcgtacttgtttcctgagccaactaacac

SEQ ID NO: 8563 - DNA, 700 bp, Nannochloropsis_gaditana
gcgcgggaggttcagcagtcgcttgttccaagcacgcccgtgcttgctcccacgcccctgtctccacatgcttcgcgtatcccataaccagcgccgcaaggtcctcgtcgcactttgtttctcttatcttgggctcctctttgatttcttcatcctcctgttcttccatgccccgccaattttcttccatgtccctcgcccccatttccccttccggtgctgggaaagactctggaggcagccaggcctccttttccttgtcttcccaatgcctgatgcgacgtggaccgcttcgtatctctctaagaagcatcccgtctgccatgactgtgtgcttgttctggatgtaggggatgcttcgggtgtgaaatgtgcaggtgtgcctgttctgagcggcccgggggctagagcgagcgggtcgctaagatttatcagttgcaagatatgccaccttttcttctagtttatattgcacacaacccacgggaactgtcgcgacggctgcattctttgcacccaagtgtctctcgccttccatatttcctatttgtcgcgccgtcatggttcaccacgtagcacaggtgttagtgttggaaagcagcctggttaaccccccaacgcttgtcttcctgcgagcgcgacttccccgctgctgtcgcggtggttttatcttcgctcgattcagccgcttacaaaaatg

SEQ ID NO: 8564 - DNA, 700 bp, Nannochloropsis_gaditana
cctggccgatatctccgattgtgccttgtattttcccccctcttcgaatgtattgcatgtagtacacatctccttgtgcaaggagtaattgtctttaggttggttgacaggatcatgagtttggaattcgaatatgggccaccaacccggattgaggggccagactccgccccgaccgcggagctaaagagtgagacaagctttgcgtttctaatggtactgatttctctcaattggtattatacgtcttgacacagatagtcgtcttagggaatcgggtctaggagcctatttcttaagcacgcgcgcttggttacattgctgaggactatctattcctcctttttattttcccagtaaagccatgggcggctgcttggaattctggaacaatctctgtcatatcgacttattggaagaatggatttggtacagctacttcacaggagcttggcttttgggtccctttatggccttcctcattgttgtgtacgatttctgctcggggtttgcctttcctttgtggcacgttgagccctctagggacaaatcaattttcataacgggctgcgatactggatttggtagatcactggccgtacgtctcgctcaaaaaggcttcagagtctacgctgcctgcttgactgcgaacggagtagaggagatcaaggcagaatgtagcacggtggagacgatgatg

SEQ ID NO: 8565 - DNA, 700 bp, Nannochloropsis_gaditana
cggatttttgttttagtatctgccgttgcgctattcgtttggtcaatttcacgcctactttgaaattagtattggcatgcatacgatcaaatgcgagccaagcacatcgttgaggatgaattccgcaccgcatcatataaggaatttgacatccgttttgcttttataactgtattttccgtgttaagtgcatacatcacgaaccaccggacgcgaggcgttagaggcgcccaaaaaagagtaacaactggtgcttttcttcagtgaggagaaacaagcgataggcaagataaatatgatttatactcaccggttcgcggaagcaatgttgtggggaatatcaaaggcagcaagtaggcctgacgcgaaaaaatgcctgtttgacagccgggggatgccctcgtggtgttcgagggcaatcaaagagagtgttcgagggcaatccgagcgaccggcacatctcaagtggaaccaggctgctgtgctgtacccactgagaagcaaagcatgtctcccttcctccgtcctttcctccaacgctagaattctgccttcacatattgcgctcgtattcacttgatttttcggtcttcacgcgccggacaacaggttggcaaccaaaacgggcgcaacaaaatacagctttctcaggtcgggcttccttcaggccatcttcagcgcagtacccgtcccccgcatg

SEQ ID NO: 8566 - DNA, 700 bp, Nannochloropsis_gaditana
aacgtcgaaagagaacgaaaaaatacacccaaaagtgtcctcgttccacaaccaggccagtgaggaatagggttggtaggatgttgaattgctgagtacgtggcagcgagggcctgagtgtcttcatcaagtttgctgtttctcggccgctcgccccgcgacgggcacccatggtcctaaaagccaagaaagccaaatcgataaccattgaatgtggctctactttgacacatataatcaaaaaaattaaaattcacaatgtttaaagtgcaatttcctactcggttttcggtgtgtttttttggctttgtgcgcagtctgcacatgttatgctatgtgatgtttctcgctctcgcacttattgccatatggtctgggcgcatgttcgtatgcagaaaagcgtgtctgccccgttattcccctagaaatcaggtcaattcaaaaatcaatgtgcattaatccttggttcggacatacttcgagaggaatcgagtcagaagtccactttaaaatggttatttatggcgatcgctcggatgctgatttgggcccatcgtacctctggaattctgtgtaattctgtgctcgccggttcgtctactcacgttcacgtactcacgcaaaaccaccgaacataacaaagccataggatgaggctcaccctggcctcactggccgctggtattgcaggagcggtttt

SEQ ID NO: 8567 - DNA, 19 bp, Nannochloropsis_gaditana
gctcctgaagcaggtgatg

SEQ ID NO: 8568 - DNA, 700 bp, Nannochloropsis_gaditana; identical to SEQ ID NO: 4404

SEQ ID NO: 8569 - DNA, 700 bp, Nannochloropsis_gaditana
acatgtgatgacaacccattttctagcgccaagcggagccttggaagttgtgagtcaaatagaagtactactgtagtacgtcaggctgcgggctgcacatcatttatttgttctttttcctcgcgttacctctcttggaatagttgacctcctatcaatgccgacgacattgctgggacttgcccagatgacgccagtaaatgcgtccacaacgtcattgcggaaatgacaaacgatttagaagcatgaaggagtccatgccaacgtgaaatgctgattattattgctgactgcgtacggcttttttgaggagcgagcaggatacgggagagcgttccgtctcagcgatcagaaggttacagggtggcgtcgggggcttgaaggtcaaaaatataaccccaactttgttgaagtgtcgcgcgtttacgttcaattgcacaaaattttgacgtgtggaggtaaatgtaggcatcaggagcggtgttgtgccccgcctcagcttactagggaggcctgtcaaggaagagacgagcgacttcaacaagagggtggctcaaggagacagatgccagggtgaccatcttggggcaaataaacaccgtatgaaacctcatagacttactgaacactttcacagccctgcttataaccgtcagccctttaaggacgctccgcactgcggacgcttctttcaaccatg

SEQ ID NO: 8570 - DNA, 700 bp, Nannochloropsis_gaditana
aactgatagcagagaaacgtaccttccatgatgcggcgacaagacaggtgtaaggaacccccccgctgccaattttcgcaacgcgataaaccgctgcataccgttctaactgtaaaatacatgtgattgcgcaagtacgttgggaacgttgttcatttgggggaaatggcaatcaaatgtccacaagacagtatagacaagaggaaggccatggtaacgtgagaattcaaccgccttctttacatttttaaggacgaacaaacatctatcaccacccagatacaccagaacaacaccaaaaataatggcgatggacactgaatccgaggacaaatggctgcaatcaaacttctcggcactccaaattactgcttttcccaccgtaggatacgagcgcggagccgggcgagggaaagtcttctcgcccctctcgctggttaagttgatgataaattggacgtgacttttatgtctcagactcacctttgttcctttccccctctggaaatggacattcccgcgtggacacatgccataacagacagcgactgggtattggtggattgacattttaccatggctacctcatacgcaaacctccccgcctggcgcaaccaaatgactttcttgcccgggaacatgcaactgacgaagccagaagacatgccgaaggaaaagacttggcggtataagggacatg

SEQ ID NO: 8571 - DNA, 700 bp, Nannochloropsis_gaditana
tgactgtactttgtacaacaaatctttcgtacacaggcatgtttgcatttgagaaagtactgcatcgagaaatttgtcgcagcaacatgcacccccgggaatagaacttatggtgtgtaagcgttgtatgcctgcgagcaccccatggaatcctatgccccttccactgtctcgtgggtaatctggcaattactggattcaaacttgcccaccgggggtttcgcgcattcgtatggccttgaagcagcgctgcaactgaagcatttcgatctccagagcgtcgatgaggaaatgcgtgtcactggcttgcttgcctttgcccgccagacaatggagcaacaggcctctcttctcttgcccatggtcagtgctgcacaccatgcagcgaaggacgcgacggcactcttaaagtgtacagatgccggttcatctgtgtccatggtatctcgttgggcaacactcgataaagaatgccatgcactgataaccacggaaggtggccgtagggcttcgactgctcaaggcctagcactgctccgattagcttgcgacaacatcccctctctctcttcccagcactgtcaatggctgcgtactgccagggatctgatccgagggcgggtaggatacagatacagggacgacgcggcgggcgaatcggagtctttgggagtttcacacgacatgtccatcctatcgg

SEQ ID NO: 8572 - DNA, 700 bp, Nannochloropsis_gaditana
tcacatgatgaatttggaggctgtcaacacttatgaaggcacacacgacgtacacgccctcatcctcggccgcgccatcaccggaatccctgcctttgttcctcgaaatagttatccgaaggcccaaaaacgcgagtcttaatgtaaaataagtacctccctaggatcaccaagaagaataaggttcttgatctttctttttttctttttttttgacactacggcgtttcgtacaacagattattgattgcagaaagtgaggcgctttccaaaccgacaaacgcagctaaccgatatttgtcttttttttaaaatactttcatttccttgaaagatattggcgcaccattgattgccaagcgctgcacataacgtcgcagttactgatgctaaggatcaagctaagagcgatcggagcgtccggtccacggtgctgcttcaggaacttgctgagcattgtgtgtcccaggacgtgatgttccaaaagcaatacgagatcttttttcaaagcagcgcgaagcttgacagcgctcgcggagcgatgtctttgtttcccgaacttggtgagggaagtctccgcttctctttctggcgatagtcggatccgcccgtctcattccgcatattcattttaccacacgttgcatcctggaaccaattgcacttttctctacaggtcggagatatttccctcttcatg

SEQ ID NO: 8573 - DNA, 700 bp, Nannochloropsis_gaditana
actgacagcaacgctattccacgcgaagagaaccatctttgtctccgctcttttctcaaagattggtgccaacgcgtaggccagggtttgatgggaagtgtgggggctacatggcgggtttccacgtggatcttgggagagaatgcaaggctgcgtagccggaacggagtcgtgaggcgccgatgagtcgagcctaggactcaatttccacgccatcaatgccttttttgctcacctgcttcgaaacatatttatagtgcatactgttgcgcctccaaactttaccaagttcagtgtcgtaaagcgcatggaaaaggcagagggatcgacccggtctgacagaccggggctccgggttgctggcttcttgagctgggcctgtcactgagtgatatgatagaaagcccaaatatcaaggctgaaaagacttgaggacaaatttctacgaggggtaaagctgcccgtcgtaacaatgtttgtccgtgatggcggctatggtagagagctccctcgccaggggcacggtgacgtctgtcagcgagcaacttgagcctcgagtgttccggaggaaggctgggcgggcgaattgaaaggcacattcccacgacacaccacattgctccacacagatttcattcttcaagctcagtgctacgtacatctcgcgagtcagcactctatcaaagccgcaaggaacatg

SEQ ID NO: 8574 - DNA, 700 bp, Nannochloropsis_gaditana
ttctggtactccgccaaagtgcgctcagccaacggaacagcttgctcgccccctaaaacgagggcgaattgaggcgcgctccatgacgcggtcaactccaaggcgtgctccgcgcgtcggagcacgtcccgatacgatgtctccttgaccatggactgttgaataagggattcgcgagaaacagccacatgtccgcactgccgacatgcaagttcgatgcacactgcaggccggcacatctctcctttgcccaggcctccgggcttgcacttgatggcaagccttcgaagcagttcactcgcctgtctcgcgacttcctttgggaaagcacctcctagacgctgtatcaaaccctcgatctctgtggatgcattgttggccatgacctgtgcatgaagaggtgtaattcgatgagcgattgagaagtattcgtaaggacgttcgaagttctccggagactcaggacttgggcagcggtggcacgtaaataggcgccaacctgaggctcgctagcgcagaaatggcgaggaggacggccagaaatgcacggctttgaaagtgacggcaatttttgcaagtttttgcaaggccagccacgaccaacacatcttactaaacaatggagccgatccggttgtgtgcactgagcagagtttggtaagccccttttaattcttcccttatttgtgcctagaaaatg

SEQ ID NO: 8575 - DNA, 700 bp, Nannochloropsis_gaditana
gggtgatggaagtgccgcacgtccgcgtgcaatttcccagggaggtcgggatggaagccaatgagtgacgtctaaccctgcgccgtgaagtcaaaacccctcccgacaagccctagcttaccgtgcgatcttcatcctccataattattgaggcaggatgtgccgaggaggggaaaacctggagaaaaatttgatgtcggtgggatggatgagagagagagggctgattattcactgaggaggaagaggtcatttttgggaagtagtactccaggagacccaaaaacgcatggacgcttcggcctgcctggtttcccgttccaaccctcagaattgagtcaaacttcccgttgcatgcgccgcagtgtggcatgattgtaaatggaaggacttggctgtggacggcctgaggctgtctccacgtcggcttcagtcagggagcgacgaactctaaaccaggcccggccacacccctacttccaagcaccgcattccccgcactcaaaacgattcatcgtcggcaatcaattgcaacgtgttcctatacttcacttgtgtacggccatatcagagtgggctcgtcgagtgccatctcccagactgacttcgtacttcttttccctctccttcaaacaaagcgacgcgattcccttttccgcaactatggcaaccactgagcctaaggttgctgccaaggatg

SEQ ID NO: 8576 - DNA, 700 bp, Nannochloropsis_gaditana
ggcgatcaagggataggtggctggatcggccaagaatggaggcagctttttctccttgtggggttggtgtggttttccgattgtgctagacatacctcgacacaggttgtggactttaaaaaaggtacgtcggacggacagcgaaagcatatctgggcagtaatttgtgatgcacattacatttaagagatagattttatgaataggcagaaaactagtatatgtcatctacacgatttcttttcgaaaacattcctctctttcgcgtggagatcgcgcgttcggactgaaaagctacccggatcctggaaagcccaggagggcgatgaacggctcagagcgaagaaaagaagcgaggcactaagaaggtacttgatagccgttcccttacccgtttccaccgactcctggtttccatcattagctgatcgtacgcatacgtcgaagggagtgtgggtatctggatggagggtggaggggattatgtgatcaaaatccctgcctgcagggctgccgtcctaatcctcctccaagcaccatcaatttctctctctccctactcgagcgagatgcagctgtggacttgctgcctggtaaattattgacatccatactcatatgtatactcattggctctcctacaggtcgtgccttatcgttgccagtacttggaagggtcagactcgacgaagcagatatg

SEQ ID NO: 8577 - DNA, 700 bp, Nannochloropsis_gaditana
tggggagaccgacgagttgcaagataagggaacgcgccgtccccgcaaaaaccacgtcgtgaggcgtggacaaaaaaagaaagagctcctttcccgcgcgggcgtgcccgcggttgcaaggggtgtcaaggcccgggcacggagaggggaaacctcggacaaatcgatagaccctccggctcgctctctggtgctacataagggtatctcaggatacatgctttatatgcaaacacgccaccgactggcgagtcgggtgaaccgcatgcgccgacctcgtgggggacaccaggctttctctttaaagacaagatgatatacatacggtacacgtgtcttcgtcctgcaagatgtgcgcacgctcaccggacataagcttggatggccaaatgccttcttttcgggctaaagcgggggaggcgagaccatctccagcgtctttcgcctcataatcgcgaggcggcgaccataatcaatatcgagctgcacccagggccagcctctcgctggtcgggcagggcgacatacacaaaacgtgtggtttctttgaaggcatttttttatgcaaggaaccaactgtggcatcgtcacctcattgcccgctccttctccttctttttacacgacaacacattttttcacgacgaaatcacacttccatcacacacacagcacagacaacctttagactgccaccatg

SEQ ID NO: 8578 - DNA, 700 bp, Nannochloropsis_gaditana
aagaaaaaacacggcatggtcgagcttagtggctaaagcaaatacagagatgacgctgataaaaccaaaattacacgactgaagtattttttaagacacgtattttttaagacactttgggtctcgtttgttttgcttttgctcatcacatctcttgcggggacgggaggtcgaggcaacgaacgcgtatactgacatttgaaaaagaggcacctgaaagccattcttgactcctccccttccttttctcttccttttctcttccttgctgagacagccacgaagggactcagaatctagtctgagtgaccgcctctgcatccaaagtctttgcccggccatgttcgatgtggaactggccctggcggaggcggggagcaagagtcacacaattatactccgtcgggactatcaagagtttcgggcgctgcatttggccttggataatttgattacaagcagcaaggtgcgtatcacatttctgacggacgatggatttgaattatgtcgcgtaaagacgcctgaaagggtgcacatgcttagcccgctcccctcacacaatagaaggatgtcaccttgccagctttgccacaatatatggagggatcaacggacgcccaaatggctgaagcgttgaccacgtacctgtacgacctcatggccatcccggacgtgactgcttcccgccagttcctctctc

SEQ ID NO: 8579 - DNA, 700 bp, Nannochloropsis_gaditana
gagggggcgggcataaatgaagcaaaggtcatactggcagacgaagccactaaacttttacatggcgaggagtgtctgaaggagattcacgcgactgtggccaacctttttgcggggggcagcacggaagacaccgcagctttgccgcgcgtggtcgtaacaaaatctgagctgggagatgcaggcgtccaagttgctgagctttttgtgcgccttgacctcgcgaaatcgaaggcagaggctcgacgacttatcaaaggaggaggggcgcgcttaaacggagagcaaatcaaagaagagacttttgtggtgactgtggacagctttgacaaaccggaaataatgctgtcagcgggcaagaaaaaacacggcatggtcgagcttagtggctaaagcaaatacagagatgacgctgataaaaccaaaattacacgactgaagtattttttaagacacgtattttttaagacactttgggtctcgtttgttttgcttttgctcatcacatctcttgcggggacgggaggtcgaggcaacgaacgcgtatactgacatttgaaaaagaggcacctgaaagccattcttgactcctccccttccttttctcttccttttctcttccttgctgagacagccacgaagggactcagaatctagtctgagtgaccgcctctgcatccaaagtctttgcccggccatg

SEQ ID NO: 8580 - DNA, 700 bp, Nannochloropsis_gaditana
aagagagacaaagtcgcaaaggtgtttttccagatgatcgtgatgtcctaacgagtttttgcgacggtgtcaggttgtagatgtgtggctttcaattgacatcaacagccgactgagacaagcgttttctcacatcggacagaagagcaaagggcgtgaatggaaagaagattaacatcaatttgacgaacacccaggtttctgattttttaaaaatgtggttttgttcttggggaatgtaaaaagctcggtgagctctcggaaccgatggggaggttgtaacggcgatcgtataccacgcggagaacgatgacctcgaagcaatggcttgtgcaaacccagttacaaagtgtactccatgggcatagaatgaagtcttgaagtgacaggcagcgcatcctgaggcttaagcttgaaaggtggactggcggcaccctgatgcctgaacggacgcttcagctgaagataccaatacgtcatcatttttacaaatgtgtttatactacaggcatacacagagacgacaaaggagtacatggagaaagagaagagtttaagaaccttacgtagacagcattctcaatcaaaaatttcaagagcggtgccgtttagcaaaatagtagagtcaccacgggtctcaagccgacatcgcgcaaaacgaagacttaaggactctcttttcttcatctgtggggtcatg

SEQ ID NO: 8581 - DNA, 57 bp, Nannochloropsis_gaditana
cgtgggaagggccggagtgaagcgacgcgtcacagtgaggtgttggctgaagtgatg

SEQ ID NO: 8582 - DNA, 700 bp, Nannochloropsis_gaditana
ccctgtatctcctaagctgcgacctagagccgttcaaaagacagggagggcgtactgaattacgggatgtgtgcagcacccgggcagtgggccggtcgcggccttcttggcgaggaccgttacctgttgttcttcaagcatgaggccttgggaaaatgacgcgcggaagcacccactgccctcccacagaggacacgcaccacggcacccattgtacagcggggaaaagcataaaaagaggcgaaggagcccgtacgggcagcagaaacacgacagaagcggggtgttggggcccttcgaatggtagctctcgcagtcgacagtggcacaatcaactcctgaagcagcgactttgtcccccttcacagagttatctctgccctctttagggcttgaaagcatagaccctttcgaattgagtggcgaggctagctctgagacccgatctcgtctgcctacaaggtcagtcgtacttctgtccccacctcgacgggaccgggaaagcgcatcgcggggtggaagaggtggaggagaaccggggggagggggaggcattgagggagacgagggcgggggaatgcgaacgtggctgcgaggaaggatgggcagagatggggacaagcaggcaatggagaagcgtcagaatttggctgctttttgggccttgggtcttctaaacaatgtcgtgtacgtcatcatg

SEQ ID NO: 8583 - DNA, 57 bp, Nannochloropsis_gaditana
ccctccctccctctcttcctccccccttcctccaggtacggcctgggcaccatctat

SEQ ID NO: 8584 - DNA, 8 bp, Nannochloropsis_gaditana
gttttatc

SEQ ID NO: 8585 - DNA, 700 bp, Nannochloropsis_gaditana
cgagggacagcaagctttccccgcgaaagtttgtatcgagatttagtatctcacaaaagcgtgagaacaatttttgaaacatcataaatgaaacatcataaactagctatactgtatacctcggatgttatggaccaaaaccctttttccgcattcgggaatacaaaaaggaatatcaacacattttgtcggtgcacttctctcaaaagttgatcacaactatgtacgactgcgattgcccagtgactcttacgccgagatcaggtttgtccctccacctgtaggcattttcccaaatttgtccaacctccccaccccacgtggctaccagccaagtggaaagcgtgcaccgggccccgaggccttgccgatgcagaccgaacaccatgccacgaaacgtactatattctctatcgcgaggttcctaccaccaaatgtgtgaccttggtcctcatctatcgagaatttgtgacaagcgacgtacggcatttgcagatcgtttcacctggcgtcgctcactgcctcgcctagtcgattgcattcgccgtcaagatcgacgtggcaaggcactgacacatccatccggtgaggacaggctttcacatgaagggctgttcgccaggtatctggtattcacgcttttgttgacgttgttaatccattacgcaacgttttcggttgctcattctcgcctacaatg

SEQ ID NO: 8586 - DNA, 74 bp, Nannochloropsis_gaditana
ccctcttgtcccccatccgccctttctatataggtgaaggcctcggtaggggatacagagggagcccggcaatg

SEQ ID NO: 8587 - DNA, 700 bp, Nannochloropsis_gaditana
gaaattgctgagctcttgccccgcacctggccccgcacgccttttcaagtcgctttggagcgccacttgaaggtgcatgcctcccgcgtggaggtcctgacctggctgggcgagcccaaagtctacgaggcggcccgggccctgatccagggctgtgtggagagtgccagggtccgggaggctggctctttggcgcgcgtgctagtgcaacggaagcacttgctgacggaggagcatgggcgggagctgcatgagtacgcgctctcccatgctgtcaacgaggatgactactcctcagcgatcaagtcgtgtatcgtgtctctttctgcgctacccacttcgatcgagcgcggcaacgctctcaaccgcctggtcagaaaggccacccgggcagacgcgaaccgcgccgtgattcgccgcatggcgcacaagacaccggagtccctccctctcgctctcctgtcggggaacgccttcgccctttcccgcaactaccagatggccctcgacaaattccttggcgcgtaccgcatggcgccgtccgagcccctggtcacccttgcggcagcagccttattgatgcgagtcttgtcgcaccggaagcttgtggaccggcacggatgcctggtcaagtgtttggccttcctcgagcagtacgccaggttgcggctagtgcagggggtggaagaagacgtgttga

SEQ ID NO: 8588 - DNA, 700 bp, Nannochloropsis_gaditana
atgatgctttcccgtatcgatagagaaccaagatgcagcaacttgccattttgcctttcacggtctcgtcaggttgaaaatcggaaagatcaaggggagaagtgtgaagttcaagatgaaagtgaattaggggcaaaggtttttgatgctttgctggactctgagtgtagagatctctctcaagatttctctccgtggtggctcgatatgtttccatacttagaaacatttacattgcattgggaatctaaagccctatcaaaaatgggctcgagcgtaatggacattgtcgcttcatttggacaacaagctgcattggaagtgttgacatttacagcggcggcttccctagtctctgcccttgcctggcctatcacccttctgcaagccgcggatatgattgataattcttggacgatagcctgcgaaaaggcggatcgggctggtcagcttttagctcaaatccttgtccgaaaagaacgtggacatcgcccgattgtattgatcggtttctccatgggagcacgtctgataatggcttgtttatcagaacttgcaagaatccataattcatgggaagacgggcaaaatgataagggacaaaagcctgaagtacaaatcaaggcttccacatcggctgtacaactgtctcctacagcttcaacacctagtagggagaaaacagagacgggaagtccag

SEQ ID NO: 8589 - DNA, 700 bp, Nannochloropsis_gaditana
ggcgtcgaaccccgcaactcagacgtcgcggcacgtttgcgcctcttttattctcgacataatccacaaaatatcaagtatgcgacattgttggctgatgaatttcaaggccgggagtctgagttggagcacgaatgcctgcgaaaatataatgccagccctttcgacgataggaacaagaaaaaaaggggtaacagcaaatcaccgcgaaagtatctttacgatagcttaccggaggcggagaaggaagagatctttcagctcattgcatcgtatgacgaaccttcggttcatgccggaacagatgaacacacacatgaatcagtaagaatttctcgcagggcgcgtctttcaagaggcgatagtgccagttgcaaaagcagcagcaagtgcagaagcgatgatagcagttacagcaaaagcaccacaactttaattaacatgatgcatgagtgtgatgataacggagatgaagtaagtgttgagtctcaaagcaacactgaaaatgaggattatctgctaaatgctgagatccaccgtatcgtaggccttcaatattcgtctacgtccgaaggcctttcgccctcaaaatcgatcgaccgagctgaaattgatcctatgatgctttcccgtatcgatagagaaccaagatgcagcaacttgccattttgcctttcacggtctcgtcaggttgaaaatc

SEQ ID NO: 8590 - DNA, 700 bp, Nannochloropsis_gaditana
taaagccgggcgggggggttagttgatctaggaggagtgctcaagactccagatgcattcttctgttgttgcgtgctcaaaagttcgcaactttcggtttgactttgttgtggctgagaccctcatcccgtatgttgcgcaccgaaggtcccacgcatttaaaccaccttccgtctatgggcctacttttggcgttagcacataacatctacctggctttgaaatcaaacatatggttcgcttgagatgcatcttccgagtcattgaattcagccagaaacgcatactattaaagctcagtggtggattcatcccttgaatgttcgctcatttattcttacctcaccagcgttgtctcacagtctgaaaggaatgaaaaccagccgtgtggcagctccatcaggggcagggggcaaggcgtcctcatctctgaagcataactcctctcaattgtctacgaagacgaagccgcaatctcaacgctacgattaccttcttatttgcagctttgtttgcgcagcgctggttgctcttcttggtaagtacagtcgaccactgcagcgagcaaagaggtccgggaaagatcagtttaatgctaaaaattagacttttggacgttatgcttagaaggaaaagtgctgaaacacggtgccaatctctcatcaaaatgacagcttacatgtattccccagcgaagatg

SEQ ID NO: 8591 - DNA, 700 bp, Nannochloropsis_gaditana
acataaaatcataatatggaaaagggtcggacatgcttgggttggaaaaaatgcgtgaaggttgctcgcaaacatccaaagacggctgtccaagtcgcgccaagatgacgacatgaaatatagaaagctgtcgttcttgcatgctctcctttgccaacgcttcgtatcaactccctcgtttctccatcactctcagcttacataaaaaacaatggccctagcaatgctctctacggaggagcgggtctgccttttaggattgttggcattatccatgccctcgcaggatcaagctttcggacgctacaacttgcgcttgttgcggacagtctcaaacatgcttggactacaggagaatcattgctcggcgctatatcctttattgcactcagagggaaatgatgtaaaaattcggcatacgcaacttttggcgtttctgaagcctttcgaaggagcagaaagtttagcttttgacgagaaagtccagttcgcacaagcatcatgtaaaaatcacacatacacagaagaacttgggctcaagcaagagccaccagctgatcaagcttatcatatcagtggcaagcgcttttcagggtcagcagtctatcacgagcggcggcgtcgttatttgatccttcgcgatctcatgataagtctggcttgtcgatctttgtacgacgcccgtacccgacgcataatg

SEQ ID NO: 8592 - DNA, 700 bp, Nannochloropsis_gaditana
cttggactcagtgttgaagtggatcgtagcacgttcctgttggtttataatccaagctttttgctttacctttcgtattgagaatagaaatgtttgagataaataagaacaacaggtgtttatcatactcttgctcttaaactaacttgcggcgctcacgtgtggtgaaaacgatagtccgtgaggaggcccaacttgcttcaatgtttgacatgtcacatcacgcacgtatcaaggcacgtgccggggagaaagtgacaagtctcgtcccgcttacatgcctctgagtactttaagggacaccttcggcctcaaatataattctttctgacggacgcacaggtccaatgttttggaaacaggcacaagtgttctgtgggatgggaaaaggagatgtcgtttctccgaggaaaatttcgcctcggcgaggatcgctaccagtagcggcaatacgacgcacacagcccaatagcgaagcaattttctactgtcatgcaccttggggatgacaatcgcgttcctttttacgtagatcacaaatagattgtttactaatcaagcatcatactactactatcaacctcccgcctcacttcccaaaccatgctagggagaaggatacttatcgccctaagacacccttcgtaatgattagtagctgttggccctacgatttattctttgacccaccttcttgatg

SEQ ID NO: 8593 - DNA, 700 bp, Nannochloropsis_gaditana
aggatgcgggaaggttgtttcgggagcttttgcacggattgcgatcctcttttgagcagttgcctctcttgtaatgtgtggctttttgaggtgctgtggtgcgagaaggcaaaatggtctgttgattaagcacacgagagacataaaagcaaacgaaacttgacatgctcgccctctctgcagggagatcgtgtctgttcctttcaatatatgtatatgtatatgtatatgtataaacccttctttagtatccattcaactctatcaagcgtcccgggcccgtccgaggcccgtctcgggtccgacagaaaacaatgtgccctcttgtcaaaaatcctccacaaatacaattaaatatgttcttagtccttttaccaattcgttcaatagaaatgagatgtgaacacgctaccgacgcgttcaacgcggaggaggggtcacaaattccgcgggataggctgcattcattgcctgggggggcgggaggttatgaacggtttatttggatgtattcccaccatgcgcatcccatttggggatgatcgtgtacattttttgtcgcccatcccaagcacttgccaacagcagaagtgactgcctaaagacgagagaaaaactgtgcgcgaaagagtgttttattgattttaaaccctcctccctcttcctcaacagcttatcggtttcctcttgaagaacaatg

SEQ ID NO: 8594 - DNA, 700 bp, Nannochloropsis_gaditana
agtttgcggtgcagcaaggtctgcgcggcatgacatgcgctttccacgcgatgaaaagactcgcggacaagcgtgcagaggagggcccgaggcttcatcccggtactctccctccttccgccctcgccccatgcatgacccatatcccttgccccgctcgcagtcgtgtagatggcgatggccaccccgcaagaagacatcagtggagggtaattgtacccacgccttgggattggaagattgatctccctttgggagcttgtgtgacgtcggagtttgccatatcgacgatttcatacgtgacatgggctctggaaatgagaggatcacatacactggtcgcagtttgcacgcgtagcacatgctctacctccgaaccttctttggcttgagtataactgtcattactcatgtaaagtgcccgaaactccttgcacagcgtgcttaatctagaatcgatttgtttctaatgttgtcttgcctataaatgttttacttcgaacaacagaaaactatggctgagcgggggaaattttccagcgcctcaaaattgcgcgcgctaatcactacattcgcacttatactgcatccttcgtcactgtgggaagcaggagaagcggcctcggtatttggaatgacgagtagcaatgtagggcccggagcagatacaacaagcggcaatgccttcccccggcgcatg

SEQ ID NO: 8595 - DNA, 700 bp, Nannochloropsis_gaditana
tctttgggtagacgcagcctgtggaaaggccgacgatccttgggagcgaaacgtaagcgcgaatggggcaaacaaccctttacaagcgagagagttacatcgcatagagagtcgcggtagatgatgcatcatggccaattgcagagtaccaaagcgtccttgtagtcctgtgtaatgcgcgtggtaaacatcagtttctccatgtggcggcattcgtgtgtcttcaaatagctgtcgccaaagaacttcacaacgtgcttgacatcaaattctgcgtctcgtctcccgacaatcgcggctgtacaccttttttcaccattcccacataccttttccttttttatcgtggaactcttttagtctttctcgcttcgttgaaggcttaaagcggcccgctctaatgtgtccgcttctaggagatcattcccggcaaaaaataatgcagctcctggtgtctcatcaccggcaaatttcttcctggtcactgcgtacaaggcaccgttccgtaacgcaagcccaaggaattagacttgaattgaatagcgtgcctttgtcatcttccccgaggccttcaacagcttcgctatctgcgatgccatgctcggcctcatggacagaagccaaagccttccatttacggcctctgactggcgctttgggggcggaattgaccgggatagacttgaaagcgctcgttgca

SEQ ID NO: 8596 - DNA, 700 bp, Nannochloropsis_gaditana
gccttttcctttcccaatcgcgcggagtatgactcctgctggtcatgactctcgtattgtcgcgaacaaaaataattaatctcctcgcggacatcaaagagaagtagtcgcgggcggcctgcctcggtatagactttactgcgccgatgggcaaaggggcaagtgtggttatcgaagctgacgacaggggtatcaggtgcttctttcaaaccagaatctgtcaattgtaagttccaaaaatgtgcccccacccagttggcataagagcccacttgaatggtcaggacttctttcatttcgtaaattggatcaccgtcgagtgataacctgccatataatggccggaaatgagaccggccccaaagcctgacgaagacagcataaggttgtggaagggaaacctgggaccagcactttacagaaagctctgcctgtgcatgtgcgtaagatgtgtctgagcctctcctgatgctttgctctgcacgtgccggcacgcagggcaggagcagcagtaatttactactcgcaagccccctgcctgatcggcgatggcggtgatcgtcgagcatttccggccctggccaaagacaggcaaagcatcgttagagtagcgtccttactcttccattccccttgaatggatacagacgggtggatgaataggcggctgtgtgggtactttgtgattcgtgaggttgag

SEQ ID NO: 8597 - DNA, 700 bp, Nannochloropsis_gaditana
gttaccgagcgcagtcacgtgcaccgcaggctcgaacacaccatcgccctctacggccggcccgactcccggttctggcgctgtctccaccgctgtctcgggcgaagcagccaacagtggcggcaagacctccttcacgacgtccggcttctgtcggagcgcctgcagaccctgaacgaggtggtggagtgcgcccagcaggaggtgaggcggctgtactacggctataacgacccctcgaattttggcctcctcgacgtggaggtgatgccctcccacacgggcggcactgtcggggccgctgacagtgtggtccgtggcggggggagcagcagcgaaggccacaatgagctctccgtggaggagggctcagcctgccccaagcaggaccccgcgcccctgacccctcggagcgacctcctgccttccaaccgccttgcccctccctcgccgcccgtcgacgccatcaggcctgcgtccttccccgccaggcagctgtccaccctcgcccagcctcatgacggcaatggcgcgggtgggggggcgcttcccctcttctcgtctgccccaaggcctgtctctcctgccgcccgagagcggagtcctgagcggcaggggcccgcgaggttgcaggagggcgacctcctagcgacggtcgagggagatggggaatgtgcgcggggctcgggcgaggagggaa

SEQ ID NO: 8598 - DNA, 700 bp, Nannochloropsis_gaditana
tcgccgaggagcacctgtacaaggccgcttccatcatccagccaaaatcctgccccctcctcgcgtttcgttacaatgccatgacatcttatattctccaggtgccgaccatgccacaataaaagtagcctgtccgtccccgaatacctgttctcgcgttgtacctcctccctcccctcctcctgcacgcgcggcaaggagtatataagtgagacaaatatacgggcgggtgctgcaggtaatgattggagaaatgattcccattcttcttgctgatgtcgatttcgtttcatgccgccctgtgtgggtaatgcgatttcgcggtgaacgggacaggaagacagaggcaacggtcgtgtcactttcgccctcggcgagaatcgagtcgcatgcccgtacgaatatcgatgacttcccttggaactcgagcgcttgcacttagaactgatcacacccgcgactttgattaacaggtgagaaagacgtctgtggagcgattgcgagtaaaaggtaacgacttgcggaggaccttggctgtcattgaaaacgcagcggcccgcggcatttggtgctgcagcgcaacgcgtgcggattgaaggaaatagaggccattgcgtgaagatatagactgctcttgaggcttggcatatttatttgctgttcgcaaaaggggtagccatattggcagaggacaagtatg

SEQ ID NO: 8599 - DNA, 700 bp, Nannochloropsis_gaditana
gcctcgtttggtggtaagatataccactttgacagccttgtcttaccctgacgattctgaagcaatagaaatcgaatctagcagtccacatatgattaaaagccggttttttaagacatgaggttttcaaatgcatacactacaagaccaggacgagaagagaaaacgaagtcgggcagtcggcactcttacacgtaccatgcttaaagccccttccgcctgctcacacgaggttccctgcagcgatgtggtggagaaattgcatacggaaagcgacgagaactttttgtcaatactgtgtgcacgagcgaagggcggcgaggtcgagcccgcacggcccccttaagcgaggcgatcgggcggggcgatggattatattcaccccgcccacacccaggctttgacactcttgcccagtaatggataaagacccgcccattttacagcgtacaggttatttgcacgcttcacggccccaactagaatttatctacagcatttaaagctaagcatggtgagtgtgggagacgccgcctgcataatgaattcggaggcctagtgatatacgttaactccagtcaaaactcgcaaaggattgcgacgctactcgtggctcacgtcactttatcaccattcatacttcattggcagagtaattcagaggaggtccctaaaaacgtggtagacgtggaggacgatg

SEQ ID NO: 8600 - DNA, 700 bp, Nannochloropsis_gaditana
cagcacctacggagcattgctttggggctgtcgaaaaacaagccagttgaagcatccgatctgatgtgatgttcatcgaaaaaccagaacacttgggtgggtagcctcagttttgtggcagatacgacctggtaaaaaagctgctcacatgggcctagaatattacatacctttcgttgcttgttacacttgcattcatccctgttgagcgacgcggtctttccattctctttgtacatgttatcagaaaatgttaatacattaaagttaaaaagatgcctgtgacgtgaagcatagaaaacgttaagcagaggagtggcgctgcagtccgatgtcaaagtccgcgtgacctcgccctgactgcctcgcggctgtcccgtgccgccggccacatgccttgcgcgcttccagtctccggctctcttcatacttttcccgcatgacactttgccactccgcttgttagcattaggagctgctccctcttgcttggccatgcaccagcttgtccgggcctggctccttacggccctgagtagaaaagagcacgagctctgctcaagatcaccgccacgtagtcacgacgtcagtcttatcacccaacatttacagccccatagacagagtcatggtgaacagaatacataggcttgccctcctcctttctttggcagccactacttctgtacatgccttcatg

SEQ ID NO: 8601 - DNA, 700 bp, Nannochloropsis_gaditana
gcagctcctctgcttgggtagcatggcgatgagcctccactatgctgctagaatccaggtccaggctcccgccaggagcattgtcgcccccaacacgggcgtcgcttcgactgacatccgtgacaggctgactccttccggtcctgacgaaaggtagtatgctttccgttgtggacgccgccattctcggatcggtcaaccattgagacagcatcccatcgcttgtgtaggcaatattgtggagtgaagcacgctgttagcctggtggggtgcggattctcatgccttgagccatctcgcgtgagttacagacgaacatgcgcaacactccccgcactaacattgtgacccagaatggagattcaaatcaatctacccgcgtcaacatcgcggtatgccaccatggttctagaaatcggggaatgcatgcattgaatgcgccggacaaacggtgtactcatgtgaagcgctcgccctttccacgacacctcgtgctcggcatcgcagttcctcgcgtgacgcacggaaaaggagcaacaaagcaatgttaatcatattgaaagctttcacatgtacaatcgcatcactgctccagatactttaaagatcgggatttcccgtcgtgcgtcttgcaaggcaaggaatgctgctgagaaggaagcccctcatctcggtcctgggagtcttggcctgccttatg

SEQ ID NO: 8602 - DNA, 700 bp, Nannochloropsis_gaditana
aaatatgcgctaaccccggctccccaattcgcattggtaggggctcatacgtttcagcgccgatccttgcctgctctcctgaagattgacggcattgcatagcttccaagctagcatcattgacttcattatcagtaacttgcaaagaatcaaatgcagatagtgtagactgggtcgtccacggttcctcatgcgcagatccgggactctgaggcttgtttccttcctcctcaaccattcctgttgactaggcaggtcgagtgttgaaaagccgcagagtgtcaaatcccgtgcggtgtgaggacagcagaataaaaccagatgagcacgaagcgcctcctatggagacacgaccggggggcctgggccgccgcgggaggagcgggacgtacaggaaggagagtgggaggagtctcagcgaggcggcagcgacggggcgagggcggtagccatgcattgggcacgggccggacgggctggctttcctttgttattggagcctaaatccgagaaaagaattggcatggaaaattaagttttgcgacggaccaagtggtggtcgtagtaccatacatggagcagtctacccgctcgctcagcatgctgcccggcagtagaaaacttctttgtcaagatactgcgttcgcttcaccgtactcattgccattttccccctaaaacacacatcataaatagcatg

SEQ ID NO: 8603 - DNA, 700 bp, Nannochloropsis_gaditana
aaacggggcctgcccccgagtgggggggggcacgtagaattttcgtgccccattgtgcgagagcttcgaccatgcaatctcgttgacgccggcttgatcaagcgtgtccgaggcgtggcgtattgcgcaaagatctcaccgcagttcgccaaccgtgtggtgacgtcggcccgcggcctcctgaaccgcctgctcccggacgtgtacgtgcacacggatcattacaagggcctggccggcggccacagccccggcttcgggctgacactggttgcagagagcaccaccggctgtttgctagctgtggatgtgcatgccaaggagggggctctaccggaggatgtgggtgagcgggggagcgcgctgctgcttgaagaggtgcgacggggcggatgcgtggattccgtggggcaggcgctggtcttgcttttgatggcgctggggccggaggatgtctcgaaagtgaggatcggccagctcaccatgcacggtatacaaacgctgcggctggcgcgcgaggcctttggagtcaccttcaagatccgggcggacactgagacggggacagtgctgctctcctgcttggggagtggcgtgagaaacttcagcaagaaggtcacgtaatgccaatttcttcgtttggtgatgtacaaagcacccaagtaaagtagcaaatactcaacttcctataaaaaaatca

SEQ ID NO: 8604 - DNA, 700 bp, Nannochloropsis_gaditana
ctagaacgcggtgtcgatctttccgcgggcaagcgccctgccaaagccaagttctcaaatgcaccgccctcacgagaaggcctcagcgatggcccctctatggcgacaacgcgtttcatttcgagtccgggccacattcagcccacgagccgaacatgcccaatcatagcgatcgcgcacactgttgttcacagcgggctcgatggtacctggccattttcacctgtttagccgcctgtttccttcctgaccttatcccagcacgccagcagtttcctctcttcacgttcccgtgtccggcttgagcccggccttcggctttgaccctgcctgcccccctctcttcatctctcccgtttaaatcttcttaaatgacagaggagcgtgcaatttaagtctttctgagcaagctcgttggaggattggaagctgcgatcgtccaaccttgcccttgtcttccctttcaccgtcacctcaaccaccccatccacacaattgacgtgacatgaactgtttcctggcttcgcttgcgaagagatcctgactctgtgtttgcttccgtttaatgtccgtcatgatcgactctttttttgcacccaggcattgctaatttcacttgtttccttccacccctgccaaagtatctaagcaccagacttctactgtcctagttgcgtttcagcctttgcacgccaaaatg

SEQ ID NO: 8605 - DNA, 700 bp, Nannochloropsis_gaditana
caccagaggctgctctaagagtgtgttcatgattgggaaagtgttcgtggatgagatttagatgtctgggctgccgctagcaagcgatgagaggtgtgccatgtccccgtgtgtcacactgcgtccatgccgacgccgactaactcctgaagtcctttaaatagccccattaaattgtacgccaccacagtgtgatgcagtacggcactcaaggtccccgttgcaggttctcgagcggtgattcatgtctccgggcgaggagtcggcttggcgtcaggaaaggcttgctcgctcagccgggctagcgcaaccagcacaaatgctgcctcctttaggtcgctcaagttatgaccgattgtgcccaattgtgccgcttcgttttatgctatcgacccatttcccgcgaacgctacttcacgcctcgaagtcatgcaggaaaaaaaatccagcacttcagtgacttaacggtgcatacgggtctgcctccacctcgtggtcctgaccttaccctcctcgtcgcacatgttcgatgtgttgttgcccgcctcgccacagaggtcatctcgtctcgtcccgtcctattggcttcatctcttaattatttcatatctttatttttcatccccgtcagcagatctttgtggatttcctcgatcaattgtgccatattttatcgtgtacccgcaacctatctaccatg

SEQ ID NO: 8606 - DNA, 700 bp, Nannochloropsis_gaditana
tgtcacgaatgcggcagccccgctgattaatgttattgaacggcgattgtttttaaagaaaggatccgtcttatcctcagcatcgggttcacgttgggtcctgtctgtaagtatggaggaccacagctgggcaggcacacccgactctctcgcgctcctagtacacagcttgcgcacggcaccggaacataaagctgccaccacgtggaggagagagtgggcgcttgttcgggtcatgggtttactcttcgaagaggacgagaaagggccgaatggaaagaacagggccgaaatggcagtcgacatgctgggagtccttgtggatcaggacaagaagggtttcctagggccccgtcttttcccttccatcctgtatcgactcaatcgatgtggtatgaataccatcacgccctccgtggcaagattacaatgccggctgctggaatttctgccctctttaggcttgcacggtgtcggggcccagttggtgcaagcgcttcttcagagacttgcatcggcgccgggcattgccgaagtccatcgattggcgcggtcgtcgggatcagcgtacaaatctttaacacacgaagctctttgtgccaccagtttaggaaccgcggcaatcagcttgtctgctgccctgtatcggtgcaacatgcgaactcttcctcgcctccggcagctggtgctggcggcggac

SEQ ID NO: 8607 - DNA, 700 bp, Nannochloropsis_gaditana
ttgggtcatcgtgccccccgcctccctcacgtgctttgaagtgtgccagtcggggcgcacgcgcgtgacgtcacgcgacgtaacggctcgctcgcccgcgcctcgcttccttccccgcctccctcgcctgcgcggatggtcgctccaaatttcgtccctttctttcaccgggtttcggggcctcgtaatggccgtacgcgaccttttctctctacaagcgtggcattctctcagaggatctgattgtattacagctgcctgggtgcgtggtcttgttcatattgccgcagcgaaaaacgggatgggttgagaaggagggggaaactccttcctcattcaatcctttgcaaaggaacaggcacaccacaacctttttcgatcacctgtatgaatcctttcactttgattgaaaaagatggtggatatcagactcattgtgttcgcggaggatgtcatcaatccagttgtcaaaatctgcaacactcccctcttttcgcttttctgtgcgcgcccattcaccaaaattggcattcgaagaacctcaaaatcataacgctgctcactgattgacattccaccttccttcacttgtgacacagaagagattctttgctcgctcccggttcaccccgcttgcttgccaagttctttcaaattaactctcaacccgcttccaaaaaatccttaactatcgaccatg

SEQ ID NO: 8608 - DNA, 700 bp, Nannochloropsis_gaditana
actcactttgcctgtgatagagggacactttctagtcaatgcaagtgaaaatatgcctgctcttatttcagtgaggttagggttagggttagggttagctaacagactgcgcgaggtggcgggggaaaagaaaggctcgcggatctagccgagcgtccgagaggaaatggaatgcaaaggggttgtcgactgcccctgatctttcttgcgcgggcacacacagcaaaggaggggttacttgtggcttgtgtttacgtgggcagccactcactcgcgccttgcttgccgcggagtctcgcggttcacgttgtttaaccgggcgagctctctcaggggtgagggactcccctacttactactagtagtactcgccactctcatggggttccatacgaacatgcctttgctgcctgtttcccacctctatcgactaccgcgagacaccgtccgccaatttccccgattcaggacttaaagcatttgtgcgacagggacaccaataacacatttgtttatctttgcaatcgttcgattgtttcccctgccggcttcctgctccatggaaggcttgagggtctacctcgtccctccccttcgttttcgctgcagatgatagccctggcgattttgtctgccaacgacttataccacaccatacagtcacaatgttctttgataaagccacgcaatcatatttcaa

SEQ ID NO: 8609 - DNA, 700 bp, Nannochloropsis_gaditana
gcatcacctccagtgtaaaagggtgtaggggagatattgtcgtcgtaaaccctgctgctgctggtggtgatggtcctgccaacaacactgccctccagagagggagaggaggtgagctgcgtactgactctcgcatccccacccgtgaatccgcctccatcggtcgtcgatgaggatgttacgtctgagaatccaataaatgacgttcttgacaggagggatgaagcagcgctgtccatgacgaggtaaagaaacttcagctctttgctccatgcctctcacttcgatctcacctctcgtcccgcatcgcttcaagggtacttgcctggaggacgacgcatgtgtcttctttcggtccttgactcgatcctttcccatgcgttatatgtcgcctaggcataatggaaaaaagttggtgttgctgtggggttctgagcagcgatgcaccatcgatcctagagagtagtcgatttgtatcccgttcttcgtggtgctgacgtacgtgaattatctctctggcactcttctcaccaaaacaatatcagtgtcagacttgcagtgacgatggctggcaaagtacttaaaaggagtgccagtggcaagcatgagtcaataaatgcggagagagtgaagactgcgcgtactaggagtcgacttaaagcagacccggaagggcctgcagaaggaagcaaggaccatg

SEQ ID NO: 8610 - DNA, 700 bp, Nannochloropsis_gaditana
ccacgcaacgcttgtaaccactgggtacgagtgtgctgcacaacattgatgactgaatgccacgccccggcgtgctcgcaagccaggaaaggctgtgcggcggggcgctagcacgctttgcgagagagggttgacgggcgacccgagcgaaggaaaatgttgccaagcctcgcttgcaggcggggctctgccgtgctctatccaatgcatccttctggcgcaattccccagctgttgacatatgcatctgcttttagttcgaagttgtgaggtaaatacaacttcttagtgtgcacagtttagccctaattttcggtggccccgaaagcaagcaagagaggtaaagaacctcgctcgcgcggagcatccaggttatcatctcttcacgtttcgttcaccgtggcttgtgtcttgtgcgctaggtgccgcaaaggggtagatagaacgccgaggcctttaggcagaggatcagctgagatttggccttcgtgaagctcgtgggtgtacacttttgtgcgtgtttttgcgaagggatatgacaagaccacctgtctcgtgagtttttcgttgcattaacgatacctgcgcatgacttgtcgattaaaacatgaaaagcactcttactcaccttcagtctcctttactgtgcatccacttataaatctccatgtagttgagggctattttgagcgtttccatg

SEQ ID NO: 8611 - DNA, 700 bp, Nannochloropsis_gaditana
agcgtggtgaaaatctgggtagttttcgctggcgtgggcgaggtgatcccaaagagaagctgatggctactaccttcgcctctggactggatgacttcccgcgtgcgtcggagcccgggccggaagagcgtcatgtcgatcttctttgctggattataaagggttgccaaattctctcgcagcttgcttttgagcgagcagcacattcgcttggggaagcagaaaaagtgcagcagaagagaggcaagaagtacgctacagtggcggaggagctccttggagcattggatgacttgcattggaacgagaccttggggggatacttcgactatggaatgcactcagaggacggatacattggcgagacctaccctgttcgatgtggaaaccccacaagtaaaacagtgaccaacgtacgcgtagagcgaagcattcttatgcagtgggacgatgaagggggggagggagagacgaaaatttgcccgcccgattttccgacccctttgggaatgctttcacaggaagccacgcttgaatactttaggggtccggaaattgctgcacagcatgtgccaaggagaggttatgtgaccctctttccccttttgctgggtttgttgcccgctgacagccaccggataaggcctcttctagactccctgaaggatcctgcccagctctggagcccatacgggatccg

SEQ ID NO: 8612 - DNA, 700 bp, Nannochloropsis_gaditana
gttcagcagaaaactggatgactcactcaaggagcgtgaattgcgagagagcgagtatgacatgttcctgctcccaacggcaacgcggccaaaagaaagagccctagaacgcatcatgatggcgtcctggtgccagtacgatatgatatttacagaacgatggtggcactcctgtgttggcttgtctgtgtatatgtcaaaagtatgatggaagaatcagatggactaaaatttcgctttgtaaagatagcatctccgtccagatagcgtttcgcttccagctgaagcagttcggaaactgcagcctggtcgcaaaaactacgaagccgtcacgcgttggtatagcgcagagagcggtagtttatttacgtttagtgtcagcctgtgtgcgttcttgttgctcgctcgctgcggtggtgcctcgcccatgcctggggcggtgcggtgagggggcgagggctcgctagaaagagagacgacgtcgaagaagccctttcacggctcttacgcgcaggcctttctcaccggcgcctccgtcacgccgcttcgcaaacacctctctcctgccagatgcgcccgtataaagctaacaaggaattctccccggaaggcctcccatattctgttcatcacagtcctcgccattcaaaccatgtctctcacatgaacaccttcttcttcgagacagatcaactgcatg

SEQ ID NO: 8613 - DNA, 700 bp, Nannochloropsis_gaditana
tccaggatataattttcttcgagttcattcaagtttttgaggatcgtatacttcaatccatactcagtattttgtggctgagataattctcaaatatcctttcgtcacgtaccaaagatttcgcaggttgattcaatctctttcaagttgataggattgcgatattcgagaggagattagtgatatttcaaacgatctatcgagaggtgaccgcgtacctctatacacgattttcggacacctagaaaacggcctctctatggtgagcttttggagtttaccatgggcgtgtatccaacagatatgtatcgaaaaaatttacttccaaaggtctcagccacgggtggatttaatattctttcagctatttccggcccgtttgtgtaccggaattgtgctagagaaggaaacatacgtaccttgcgtcgatagtgctgtacagattccaagaggaaggagcaaggagcacgctccgttgcgcgcgtagctagttcttcgcttttgcttgctccttccttgacatcgccgaaaatcgcttacttcggcctcggcaccttccgcccccggcgttcgaattccctcagagccctctgcagcgccttctcacccgtgactactcccacatcagagatcagccccgcggccagcataatctgaccagcctgtcaacagctcgctttatgtttaaatgagacaaatg

SEQ ID NO: 8614 - DNA, 168 bp, Nannochloropsis_gaditana
cgtcgtacgacgagtgggatcatgatgcttatgatgcccaaggtgtgcgacgtggctaccggaggcgcatggaggtataagtagcctcgcgccacatcacatcggtcttgcttacacagcttccttcttcgcttttcttttcttcgtggcggcccacggccagcggag

SEQ ID NO: 8615 - DNA, 85 bp, Nannochloropsis_gaditana
catgcattgacagtgatccttctccccgcatacaatgcgaaaatattttggcgagcagcccttcgcagagcaacgccccatgatg

SEQ ID NO: 8616 - DNA, 700 bp, Nannochloropsis_gaditana
ccatttcaggtgtttgagcacttccttgcaaatcctccaatatagccagagaaagagcttttcccgactgctgctcgtccattccaaccatgattattctgttttgtccaaattgaattcgtgcgctttaagaaatagaaagctttatgacaatgctttacttctatagaagtatcgcaatcgaagccgccaggaaaaatcgacgctcgtcccccctaaccccatggggaaaaacagaaaatccacccagagaccgtcctccacgcatccatctgtcccttccgatcgtgcgtgaatgccaacgcgtccatgcaagagagtggtcatctttactagtggggtttttaacctctctgagggatctccgtgctgcgcgtcgatctttgctgaaccgatcctctcagcccccccccacgcccattttaattatcccctttgacagcccttagggctgtgcaccgtgaccatgaaccgcgtgttccgattttgagagcgttgactttgtgccatattcttgcatgcgttgatcgggtagaagggatgatacgatgaaaaagtgtgcacgcccatgcacactgcctcgcgcatgacttgcacacaaggcgctgcaacacttcagcaatggcccccgtacacacactcatgacccccttacaagacagaaactcggaagaaggcggtcccaatattcagtatcatg

SEQ ID NO: 8617 - DNA, 700 bp, Nannochloropsis_gaditana
  misc_feature (1)..(687): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctccccccccc

SEQ ID NO: 8618 - DNA, 700 bp, Nannochloropsis_gaditana
gattttatattttgataaaagacatttttcagcatgcaccctggcgacgggaaggccaaaagcggacagagggtagtgataaaaaggggaggaggttaacatagatggtgtgatatttcacaaaatcaggtagctcccgcaagattgagtaaatttttcctgaacacctcgttcggcatctagcaatgactggagatcacactgggagaaactttcagccatcacgacgcaaggatgaggccggtgggcgtgtcgttgagtggcatgtctggtcatctctctcgcctagcaccacgtatcgctttatgttacctatctggtcatcactcgcgctgagccctttcatcaattatcgctccaagtgtactgctattcccttctgtgtggttaagtcgttgttgattctaggatatgcaggaggggtacgcgctctcttgtcgccttctgcgtgccggaccccctcagatattccctgcggacaccaccttgttgcgcatggccggacgagagatgcccgaagaatcatgtactctatctcgaatatcgaaaaaaggggaagattgcgatatttgcacgcctgccttcgttgctgctgccgcttgctgcttcaagctaatctgaagtgctaagcctatcgtctccattacgaccaacgcacaaaaaacagacacttcttccacttcacagcttaaatatcatg

SEQ ID NO: 8619 - DNA, 700 bp, Nannochloropsis_gaditana
gtggcgtatgcctgtgctgaatgttggacggaaagccggaaggcgattctaccgtcatgaaacaggattgatcgccctcctcgctcctccttttcttcctatcgccctctgtgccttcccttccctcgtattcccgcgcttcccttcccacattcgacgctcggcacggacggtggcaaaagccccgattcttttgccacccggaattcgaatccctttctttcccgtgcgggcaaagggattgagacctcgcgtcccacggagattttttgtaactaatgaggtactctactctaaaagtggtttcttctgccaagaccctctggaagcatttctttttccctcgttctctctctctccctctctttctgtttatatccccttttaaccccaaatttgttccatcagaaagtgtggtctgtgcgcctcccctgtcccttttggcggccgccaccctccttcctgatagatcaacgtttcctcttgttcctatcctctattcatcgcatggggcgactgccttgctcccatgctcaccctgagggccaaattgctctacacaatacatactctctcacgtgcaagtatgaaagctttgactttaggtgttaaaggctatggccgcatgtagtaccttcaccctactagggaggggctatcttaacctccctcctctgacgactttctcacagacatcatg

SEQ ID NO: 8620 - DNA, 700 bp, Nannochloropsis_gaditana
  misc_feature (1)..(201): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggagggagggagggagggcgtggcttagggcaaccagggaggggaagcctctaccccagggcacctcgtaggagcgcttccaaaaagtacagtggcccggcgtcggtagcgcggcttgagagacctgttttgtggtttgatagacttaaagggttagttaattgggagtctggtgtagtggtcgcatgtctgtgaggtttattcgcagacattcgggacgctccctcccccgttcagcagctttggctccgtcgtcacgctttctagacacatgtatcaatttgtcgtttttgcgctggcattcgagtatgttttcgccagcaatgtgaaagtttacatctattttatctgcgcggtgtgcgacgtgtgcgccgaaaggatgtagatgtcagcattcgttctaaaggcatcaatcaggccaatttggcctgatcctcattctcattctcacaacgctatatccccgttcactttcgtcacttgtttaagagaatatg

SEQ ID NO: 8621 - DNA, 700 bp, Nannochloropsis_gaditana; identical to SEQ ID NO: 5286

SEQ ID NO: 8622 - DNA, 700 bp, Nannochloropsis_gaditana; identical to SEQ ID NO: 5291

SEQ ID NO: 8623 - DNA, 700 bp, Nannochloropsis_gaditana
ttatccacacactggcgtgctggattttgcggcgagcgacttgagctcagacaccggcaccttgcagttgcgtgcccagttcccgaacaccgacgccgatatcgtgccaggtgtctatgcccgtgtgctggtgttttatggcaaaaagcgtgagtcattgttggtaccttttaacgccaccatgcgtgaccagcttggcaactatgtctacgtccttgatgccgacaagaaagcccaacgtcaggacgtgaccttaggtcaacagtttggtgctttggtcgaagtcaccaaaggcctcaaagacacggacaaggtggtcatcgatggctttgtgacgttaagcgccggcttggtgactgatcccaaggacggtgagatcaagcctgccgtgttgcccggacagcagcccgcagctcagtcatcaactcagtcatcaactcagtcatcaactcagtcctctaaccaaggttcttgacagcattggcgagtcggactcgccaatgctgtattcatgcttttttaatgacttcctttctgtcgcgccctgtcaagccatacggattaagccaaacggattcgccacatgatttcagcgaccttcattaaacgcccgattctcagtaacgtgatcggcatcatcattgtgttgatcggcgcggtctcgatttttgggttgccggttacgcagtatccgccgatg

SEQ ID NO: 8624 - DNA, 700 bp, Nannochloropsis_gaditana; identical to SEQ ID NO: 5012

SEQ ID NO: 8625 - DNA, 700 bp, Nannochloropsis_gaditana; identical to SEQ ID NO: 5014

SEQ ID NO: 8626 - DNA, 703 bp, Nannochloropsis_gaditana
gctgtttccatgcgccagtgtctgcgagtgtcgtccacccgctccgacgttttctccgccctcccttcgcattgtaacgtgggacgtgaatacgtgtgcttttttgtttgtggttcactctcttacggctccatacatgattattcgttttgttttgcgtaatcatcagcctttgttctgggtccggagcccgcattgacttttttctccggaagggttgggccataccaggaggttggctccaacggctcgagagctcccgcgtggatgctcgcccgccccatgtcccctcatgcctcaatggtgggaaagcgttcaagaccccccgtgttccgttgatctcttccccagcgcatctcccttcttctaggcgctccagtgtgctacgcggtatacttacggcttgtagagagtcattgttgaatgatggcatgcacgacatcatatgtattgcttccttagccaccgggcaggaacactgtcatgaagtgttgctttgattgccttgagtgaaatgcttgattgaatggtgttatgcatgcaatgatgtacatgaactcttacctagtggagtcgaaatgccatttcgagttttttaatggtacctgttcttgtccccttcctcggccgttggtctcaggttgaatatccactgctcaccagtcgctctctttactgcacgaaacgtgtccaagagttaatg

SEQ ID NO: 8627 - DNA, 703 bp, Nannochloropsis_gaditana
agaagtgaaaagagacgaaggtgaggaggacacgttatcattggcttggaaactagggagggagatacgtgtgcttgtcctgcacattttgcacggaaaccagaggcccgtgaacgcgagaactattccattttacccaaatgaggagtgctacggcagttgtggattcaaatgttggtctttgtatcgcaatcgcttctccagtgccagatcaattatcagaaggtagggcgccacttatgttctctttaacttgtccaaacttacctcgtcgcttccgtatgcgtaatccacgtcgctgccctcgtcgtcgctgtacgcgtatacttctccttcatcgtcggacatgtttttcccctactatataagtgtctatatgtaagcgggacaagaagttcattggactcctcttgggagtggtccgcacgccatttgcccgatttgaatgaagaagcactcaaaaaccctcccagcaatcgcgcaccaggcagtttgtcgggtaatgtgggtgtgtaaatgcagattcagcagcctaggtagttcccgagaagtctttcctttatgctcgctaacttttggctgtcgtgcgtgagatcgccggatctaaggcacggtagcgcgaataggtcgctttcttatccgcaacccctctaacaactaatcatgcccatgaaaataactcaaatcatcagcgaaagttatg

SEQ ID NO: 8628 - DNA, 703 bp, Nannochloropsis_gaditana
tccattcgcgccacaggggctcgaacgggaggctatcaatgatcaggatgagaagccccatcctgcgcttcttgatgcagcctccactcgcctcactgcgttttagcaaaatactgttacggataaacctacccgctttaacaagacgctgcccaagtcttaagctggccaatctcgcagcctcattcttgcgctccattgctgcgtctttttgttccttcttctccagggacgccctcaggcccttaaacccagcaagttggtctctgaaactagccattcgtctgtgacctgtaattcaatgtctttggatggatatgcataccgaacacatgcgcttcgtgagtcctaagcgcgtgcatgtttggcccaaaagacgcgaagggatgaatcgctaactcaagtccgctcggttcaaccggacgaacagcaagtactcgaccgcttgttgctttggaggccaaatcgggaaaagaaatgtatcggatggatttttttttttaaatgcagtgaattaggtccgcgttttatttttgaactgttcttgacccgcacaacgtatctttcatgtcataaaatagccttccatcccgtttcagggtttgccctcccccccccccagtacgcatggcccgacggtcgcactggctgtacgagtggttctttattgccgccttaggttcgaactggctccaaagtcatg

SEQ ID NO: 8629 - DNA, 703 bp, Nannochloropsis_gaditana
gtgttcttctcctagctgacgtgattcgacatgcacagtcggctgtcatcccctttcttccctctataatccaaagattggcaagcgctttgattgatgaagaggctgaaatcgaagccgctattgcagaatgtgcaagatcattaggagaaaatgttgcagcttccgtcgtcgttcacaaaacattgccgattatgcagggagcaacgggctttgaaattgaccaccgattcgcgggacttcgccttctacatttcatattaattggaattgcggcaagtaggagaggtgtaggtgcagaatgcagcagagcatgcgcggaggagcaagtcgagctttcaagcgaagacgtcgagtccgtatttctctgcgtatataatgaagacttttattctggagaatggatcaaacgtgcggttgtggcctctcaatccgcgaaaataatatcttcaatggtaaaaatcgcccctaatgcttgcgcatcgataaattgtcaaagctgccttatgctggcgattttgcacgtcttagctttctcttctgaatctgacaggcttgtgcacgaacaccatggtcaaatagtggcctacttggcgagcaaaagctctgaagcagggagtgatgatggaagcgaagacaaagaatcagtttggctggaccatttcgagtccttattaggaaaggtaacggctgacgcagtgaa

SEQ ID NO: 8630 - DNA, 703 bp, Nannochloropsis_gaditana
tttacatcgaactcgctccggctagcgggaatgctcgcgccccgcaagcagcggtatggtatgataccaccatgccttcgcggtcctggaacgcaagcacgcgggcccggactttgccttctccgattttattattttgtgagcgcatatggagtcatttgctgagcacatgctgtgaaattgtgtctttatccggcttcacacgaatactggaagctctgactgccggcgtgcttcttcgcccgtccccggtggactgcttccacccgctctttttcttgctcgatttatgttgagaagctcgctctatttgtaccctcggagctcccagcggtgaagtcaatgatggattggcgtaaattgaattcaagcgcaccattgtgtgccgatcgtttgccaacctctggttttaagaagcgcttggtatgctcgaaactctcaatctatggagactgtgagtcgagtttttcttctcaagctcagtcgagcattttgctttgtccgtgcatcttaagtgctcagattctggccaatcaattatcgttgcttgcgaattgacgcaggcgtcgcatcgagggctttgtgacacgtgaaaaaacgggctgaaggtcaggacgcttgttccaatgctaactatctgtgattttccaacactcctcagcagtaaacagggtctcacacgtaaatatactttttcatcatg

SEQ ID NO: 8631 - DNA, 703 bp, Nannochloropsis_gaditana; identical to SEQ ID NO: 113

SEQ ID NO: 8632 - DNA, 703 bp, Nannochloropsis_gaditana
gtcgacgctccggacctttttggaggacgcagaaaatacgggcaattttaaactggtggctcgcgcccacgtcgacaaggtgcttagaaatgacgacaacgatgccgtcggtgtcattgctacggtgcacgaggaaaggcggttggcggaggggagagaaagtgacggcgaggggaggcctccctctggccatcgccctggcccttcgacctcttcgcgatatcaattgatcgtatgggctgatcacgccgttatcctttcagcagggtcgctccactcccccgcggtgctcctgcgctctggcttgaagcaccataagattggacggcaccttgcgttgcaccccgtatccggtgttgccgggcttttcccctcagagacctcagacacgcacttaggggtgggcatgggaacctatgtttcggatttcatggggggtgagatgaaggatgggtggggaggcgcgattgagaccccccctagccacgcgggtctggcaggagtgatcgcaccttacgggacagcattcaactaccgcatgtgggtggctctgaaagggcactatgccgtctccattgtgatcagtcgggacgagtcctgtgctgcgaatcgagtggtgatcgacaatgatggggaaccccaggtgcactatctgttgaccaagaaggaccaagcgaatctccagtattctgtaggggtgatg

SEQ ID NO: 8633 - DNA, 691 bp, Nannochloropsis_gaditana
gttccgaccgcggctgtcggttcggcccagctggagatgaagaagatgatgatgatgagtgtgatggaaaaggtaccctttacgcaagtcccttgccctcccaacactctccagctccttccgctccctcccacgcttcactaagaactcgtcggttcatggcacgtatgagggaatcgacatgcattaccacttaattgtcgtcaagtatagagtttttggaagggggggggtcccagaaagtgattaagcagatggagctcgctaccctagcgtaggaagttctcccgtggagagactacaaagaagctctcatgatgacgctgggctcgcttttaggcccctgcgacgacgaatcataaagcctgtgatgccctggaattcatggctctctgtactttggttgtggagccacaccttgtgatattgctcgcaacgtgaattgctccgttaggtatcgttacaagcagatgctgttagcgaggacctagaacccttcagtggatggaatcgaaatgggagaccatgatgccccgtcacggactcattttctttacaatgcggctcatctactcgttgagaagctcctgctgacataaaggcgcattactcatatgaccctccacattttgtagggtgtttgagcacgcacaacgcaagcaggcgcgggagcaccatcggaggggacatg

SEQ ID NO: 8634 - DNA, 703 bp, Nannochloropsis_gaditana; identical to SEQ ID NO: 1472

SEQ ID NO: 8635 - DNA, 703 bp, Nannochloropsis_gaditana
agtgaaatcagcgcgaccatgaaggatttggcggggagggcgcggcaagggaagttgaagcctgaagagttccaggggggatcattcacaatctcaaaccttggcatgttcggcatcgatgaattttcggcggtgatcaaccccccacaagccgccatcatggcggtcggaagaggggcaaagcgagtgcgagctcctccctacctaccggatcaacatgcaggcaacttgaagccttataccgccacggtaatgactgccaccttgtcctttgatcgacgtgtgctggatgaggctctggcggcgcaggttttgcaagcttttaagagctacatgtcaaggcccgagctgctgttgctttagatgtcgttgcgcctggacgggatcggaggacaggcaaagcatggaacagaaaaataggctaaagaaaaaaagaattttgtgactgcccattgcgatcttaggtaaattatttacgtgtcttttgtcgtttatttttccgggggggaatgtagataggggatcgctcgctcaagaacgcactacgcggagggcgacacaccggccttatcccgccaagctttgaagccctcacttcctactttgaatacatttcgcttcgcacgtatacagacattttggagacctcagccttagtgagtcgtcgggggtgcggtgggtgatcagtcacggcagcatcatg

SEQ ID NO: 8636 - DNA, 703 bp, Nannochloropsis_gaditana
catttttaatcataaattatacattttggggggcatttcttttcaatagtggtcaggactgcacggcttccggtagtcaaaacaatcatccacttgcacacaagttggtgcatctgaaagatgtgcatcgggtctgtttcggccgctattccgccggtcactgctgcttctgcagaggcggtggcccaacattcgtcgatgcctgtaccggaatctgatgcgcaagatggagacgcatcgatggatatagtcgaccgcttaaatgtacaggcgaaacatttagcggcgaagacaatcggtgtacctggtgacgagcattacgcatgcttacagatggtcaaagagggcgccacggtagggtctaggacggggaatgaggggcaaagcgcgaaggaacaataaaaaaaattgtcactcttgtctatgtccaaatgaatcttgtgagatgtatgccctgaaggcatcaactccgactctctcctcttattgtcccttccactatcaattacaaaaggttttcaagcaccgcatttggcctctcatgtacatatattgggcatacacggtttacggcatcttgacggggccctcccttgcttttgcattgggtgctttcgtgctgacttacctgtacatcgacctttatggcgccgtcttacacattgttcttgacaacccgaatttcctcaaactgcccctaata

SEQ ID NO: 8637 - DNA, 703 bp, Nannochloropsis_gaditana
tattaatatggggggagccaacgcacagcggcggcgaagatgcgtctcgccccgccggaggacttgttccatctcttgcacgccatctatgaagggctcttgggcccaaaactttgccaacaaacacccatacgtgtgcaccgttcggatgcattgttgtcgggtgctgtatggagggacataccaagttgtgggtacccacttcggaagtagcagagggctgtgggacgtcgccctgggaggaggtcgaagccgtttcctcaagtgcaagttgcctcacgccacctttcccacctccatgcgcttggacaccacaggacggcaccgtgtcagacacaggatcgaaggggggtggaatcagacgacaagattgtcgcatggccagaaaaagtgggccgtccacaagagagaagtggaagctccttcccctccttctcctccccctcctccaccctgctgcggccttcgttcctccctaccgcaatcccgacatcgcctttgacgcacgtgaagctttggttacggacaacagagttgagtccatctcattccgccgtctgtcggtgaaatgtgctgaggcgacctcgagcgcccccccagcctcccctccccagcgccctccctcctcccccagatcttctgaggcgaatcaacgctcagtcatctcttccaccctccctggtggcaattggcccccgaacgg

SEQ ID NO: 8638 - DNA, 703 bp, Nannochloropsis_gaditana
gacaggcgtgtagaacttatggcccaagtccatcggcgacacgagaggagggccgttaagagtaggtgcggcgtgctaaaaatgcacttccactgtccgcaaccaaaacatgccatcgaggcagtacgtttaatggaatgtactttggcgtgtgtgtacttggcggtaaaaaaaccgcgggcataaaaaggcatgaaaaggaaggcaatacttcgctttacccccccgctgccccggtacaagatcggcacatgtgtccgtggtgcgtacgcgctttgtgacttaatcatgcctgtaatctccttgtaaaatccctccccacatgcatgtgaccacttggtaactctgtaaggcgcgtttcacttacacggtccaagacggggttgagatcatcgtttatgccacaagctggctttgcgtggctcgccaacacctgcggtcgcatcgttcttcctcctggtggcccgaaatcctgggtttctttgaccatttttgatgcctgcacagcctacaacgttcaagtcatcctattttcgggatgtcctcatctgttaaacaggcatcatgccaaaattgtgctcgcgacctgattgtgtgataggcaatgattgtgtgtttagctggcccacaaaattcgaatttctcagtcgtacactccgcgaaccttttcaagtgtctagtcggcccctttctgcctcctatg

SEQ ID NO: 8639 - DNA, 703 bp, Nannochloropsis_gaditana
acgtatacgagatagggcgtctgtaaccctagcagaccggcctttcccgtagaaggagcacttccaaaggcgctcaagggctttgccattgccacaccacgtcgcgaatacgcaaaagaacgaatcgacaaagagagtatagtccaggctgctgtctttgcaatatgacgtgctgaacatccttcttgtctcgtcatgtagatgctgtgttttgacagtggtattaagtatggtattcttttacatggtgctattatacggtgtatcaatgttaaaacctaaagatcaagcacgttgagtccctgcgacagagtttttgtcacgtttcatttacatttttgaatatagacctttactactttcccaagagttgacatgaagcaacgtctgacgttgatgacgctttcttgagacccgatttatctcaagattgaataagcaagcaagacaagcccagggagcatgacaagaattttcccctcctatcgagccccgaaatccgtttctttcaacacaactcgcctaccgtcgcacacaaccattttccatcgcaacatgaaatgacctcaatggcctaagcacgggacagcaataacctcctaccccctattcaaataacggcaaggagcggggggaagtatccacatgctaaacgacctctctcgtccttgagtaaacctcactctgcaggtaaaaaattaca

SEQ ID NO: 8640 - DNA, 703 bp, Nannochloropsis_gaditana
cgccatcggtagcccgaccagcaccctgccaacaacccagactcgagcgcagacgggcggcggacgtcaccactcatgacaagcagcataccattgagataaaacaaattacgtccctttgaagcaggaagatgaaattgtgcattcaaatctttcaaatttaccttgaaacacactcttaactagtatgttgcgagctttcccgctcctagtggaagtggaccgctcgagatgcttttaccacagcaatgcaaccttgcgtttaccatatccatagcttcctccgattttattgggttccccgatcgaccaaattatttgattactcatctcaaaaagaaaagcaacaattcatgcgtcagctatttttcatccaggatgaaaaatggggtctgattgcgcatacgacccagcctgcactccggccatcttgtgagagcaacagctcgtaggtgcaacaagttgctagaagctgacaggaaaggtaagccatttttcaaaatatagaggcttgattttgttgctgcagcaaaagtttgattgggaagaagtgaagggggcaaaagatccaaaaagatagattgtggatttctggttttccgcttgcttttctaaaagagaagggatcggaaagggggaccgaatggaggatcgtaggctgtagacagtcatacaaattatcaaccatcgcataagttgcatg

SEQ ID NO: 8641 - DNA, 703 bp, Nannochloropsis_gaditana
gacggcaatttcaaaggagggagtagcccaaaaacaggtaaaatcgtccgtcgcgtctctacccgtcactcaagcaactcaaaagagtcacaaagtctactgcgcgatagacgggcgcccaaatgaccgggaccgcggtgatctggcaagtctccaaaaggagggggcgggcgaagccactgcctgaagcctccctccccatcacccgcaggcgacagcgaggacccgccgcgccgccccggcccggccaggtcctatgcctgcaggggccagggtgtgtgatatgaagcgtccgaggcggacaaggagccatactggacttgcattgtcttggctttgcaccgagtcgcgtactgctcggtgctcacaccgcatggcgagcggagcgctcccccggcttgcccttgtcttggccttatcatgccatcccttcatgccgagggactcttgcatatggcctagacttatatttaagcgacaaatcataatatgatctctctcacatttatttctaacactatgcttcaatcgtgggccacagtttacatccacgaggtagtaaatagacaggacagcgcgatcattcagcaactctcctgctaaaccgcccctttcctcctcctcctgctcatttactgcgttgtttgggtttcctcaagaacaggaagaccattgaaatcctaggggtgggtcatatacgatg

SEQ ID NO: 8642 - DNA, 703 bp, Nannochloropsis_gaditana
tccctactaatgcaccaaagtgccgtgtgcatctcggcacggcttcgaaacaaggaccctgcgcatccaagcagaacaaaagcctcttgcctcccggccctcctgcctgtccagcaacggctgggcccatgtcccttgttcttcgcctgcactgggaggggtcacagcgtctccgtggcctttagaaatcacgagaaccacctactgtgacaatgacagcaaccacaaaagcatttcaggtttatctgcatgagttgctctccaaattgttacagctatgtttttaagtactgctgaacctccacgctgcgcatgacgacatacacatactccttcacttctctcacgtcgctttacagtgggcagcctgatgtggttcaccaaatccagggatcccagccctaacgatgatgcctatattgctgcattttacgacgaattggatgctgctgaaggccaaaatgaggatgggcgcacaggtgaccgccccaccgcggtagcatcgatcacggaggggcttacagatgcagcccagagcatccgtgccttcatcgaattacagcaacaacaatggatagattcgccttatcatactagtagcatggacggcgttgtctcgccttcctcaatcggcagtacacctcccatccgcctggctatagtcacaagcgggtctgtccccacacctctggacacgggcatg

SEQ ID NO: 8643 - DNA, 703 bp, Nannochloropsis_gaditana
gtggcggttcacatcaaaaatccaagctatttgtgtatttgactgtgatatagataaatcactactaccagccgatggatacgaccagggagggattacatatgttgtattcagggctaaagttacggttttagatgcgcagctgaagcgaagatcaactgctgttggctgagagggggaaggattgacaaggagggacacctgcactatcacttcttgatttagaagcggaccaagcggcggacatgaaaccgctgtgactttaggtgttaggttcagaaaaggccttccaaaggtatcaagaatgaccaggcacaggcaagcgcacacccgcacgccattgtagcgtggacgagaaggaaaaaaattctccataactgttttttgttgtgaaaagggggaggttcagtagtgcaaactgtaattttttaaataaaatgtgcattaaatgcgcttttaaatgccattaaagaccaagccttaatatttaacgtataaaagttagtgatgtcgtgcccctcgccatgaaaagacgcggtgaaatggacagagggactgcgagtgagggccgtgggccgcgtcaagggccttccgagggggaaaagggcgaagcctcgctcccgctcttccatttcacacaccctgccttgtacgtccacttacacgtcaaaatacatggccacatatgtatacagacaagatg

SEQ ID NO: 8644 - DNA, 703 bp, Nannochloropsis_gaditana
cgtatctgattagataaagtaagaagcagccattcgtgcgtcactcccagcgacagcatacccggtaacacgggccgcgggcagggtaccccacacgcacacatcctcacccagcttcagaccactacagacctggacaagtttttttatcttgatgcccgggttgtcgttttcctcatcatcggagttctctgcagggcgaatttcagagtgtgaaggaatgttgaaatactcgggtttgcggaacaaatatacgggccatccctgcctccttcctgacttacctgctctcctacgccgcatttgcttccctctcatggtcagaaagttcctgttgcgaaattgtaaaacgctgtgtagcaaattacaggtgaagacggcgtgtctgtcgggagcgcaggattcggtcggcctgagaagctataagaatacacacccctctgaccgtcgtatacatcgtcgtatacatgtgatgctatgtgtgcgctcgcttggcctcgtgacccttcccctgtgaaaatatctaacactttacccaaaaatatgtgcctatctcatccagactttcccccattgaatcaattcacgtcaccagcgtacttatttacttttccattcgtaattttcgcccctcaaccgcaatatgcacatagcgtccctagggccatttgcaggcagtcttgaatcgacgccccggacaatg

SEQ ID NO: 8645 - DNA, 703 bp, Nannochloropsis_gaditana
gggctgcttctggagatggagctaaagtgtaataaccgcgaatggatataaaacctgctcattagatgtgaacatacgtgggcatcctagtaaaatatagttactgcggttgaacaaaaagacatggtggtgatgcgtggcaagggtcaagccataataaagcgtaaaacgcgatgtcaagcacggagcttcttattcgctcctttccggcgctgcggggtcgtatcttgcgggcatagaggcgcgtaccacgtatctgacgtggagtagtaaagacatcttctgacagccactcgcatttacgatagacttcacaggcatagactacgttgcgtcgttcttgactcctcatttggctgagcatccgcggggctccgctcaccatcgacctcctcacccccctcccatccacccacaacagacgatgtcgctggaatgctactggaagctggtgtcgaccgactcagacaagcgcatccaagcgggctatgagcttgtcgagtctttgtccaagagttttcgtcccaaggaaggaaataggcgtccatctcctttgccttcagaagttgagtacgccataaagcgcttggtccggggcttgtcatcttccactgaagcagcgcgtcaagggttcgcctcttgcttggcagaggtgcttgctgttagaccggatgttccactgtccttggtccatgaacacatg

SEQ ID NO: 8646 - DNA, 703 bp, Nannochloropsis_gaditana
tacgcgtcatcgtactcccctcgttcgtacttgaattttgcgtagtcgtagtaggcgggcaaggcggcaagcagcttttctttcatctccaatttctcggcgggatccgttgcgcccgcggtgacgtactctttgatcgtggtcatgtcctcaaggctgaacatatccaaagcatcccccgcggcttccctaagcacttcttcccgctcatcgtttgcttgctgctgtgcctccagttcgggggggatgtcttcctggagttcctccagtgcacgtagttgcccgtccacattcttagtcttggcaaggagggccagcttcgctcgcatgacgtcgtcataggaatagtactcagcttgttcgataagaaaatcaagaggtccatccgactggactaaaaagtgcacgtcggtaaaaggggcaatcttctgagtgagatcgtactctgccatgccgtgtgcgaaaggacaggctcaagaccagcggacacgaaaggcaagctggaagaagaaacgaggccaaggaggagctcgatgaaattaacacgtgtacctcgaatttcgtctatcctgtgcacggtattcagtgtgggtatgaatgggatgagtaaaattcatcaggaacatggtaaatgtagtcgaacgcaggaaaatcgggtcatgaaggtagaatactagtaggccaatgatgaccgccggatatg

SEQ ID NO: 8647 - DNA, 703 bp, Nannochloropsis_gaditana
tcaggaaagtatgagcgatgtgcgcctctggaaagggcggcaacgtcagattcgaggagggtgtgtgtgcaggaaaaagtaagggctggaaaatacaccgtgcaccataaatgacatttactgggtcctttgcgtgaatctagtaaggaatgtgacaaaagtggtttgcgctgtggctctggacttcaggaaaagaagaagaaacaacaaagaaaatggaagcatttatgattctcaccaagtcgaaaagttgatcgcaagaaatttgattgcatgctcataaaaaagagatgcacatagactctgagtgcttcgtatgtcccgaaaatttatattcccgttaccgggcatcggtagcactgggaacaaaggagaggagatacagcgtcgtcatagaatttataaattcaaacaagccgttacagagtaacggctcgtccacggcaccatctcgtcctccgcgagatctttttgactcgcaatggggggatgaggcctcatccatatggatattcaatttccaataaacgaaacgataatctaatcctggtgatatctctgcacagctagggaaaggaaatataggtaaactggtgcaggttgttctcgtgagtaatacgcgcaaagaccccgggcactgtccgataagaaccaaatagcgagacgcaagtagcaatatcctacaatacaggctccacctatg

SEQ ID NO: 8648 - DNA, 703 bp, Nannochloropsis_gaditana
  misc_feature (1)..(599): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctgtcaaggccattgccgccacaacaagctcaaggatcagtcagggggtggacgcggcgctcccggcgggttcagagtggaacgccgagttgaaagggatg

SEQ ID NO: 8649 - DNA, 703 bp, Nannochloropsis_gaditana
cccgtcgtcttttaacaggattcgtgtagtgcgctggcatgcgagcatctccctgttgagcatggcgaggaaacctcaataacgactaaaagcggatgggagaggacacgaccatgcagctaactttcccgcattacaagatccagaaaaaactgatacaagtcttttagcgactattattaggaaaaagaatgctagtcagagtgattgagctccacgtggtcgtagactatcttcatgcctttactaatcgtcgctttttcaacgcccctcacaacacactgctagctaccatcatatcggcgtgaccttggaaagagatgcgttttggaaaaaggagatagtctgagcctgctacagtagcagcagttgcggcagcaagtgtaaaaacatccgggtggacgtttgtcgagaagcgtgtgcataattcagcgctgcaattgctacaaattgacgtggaaacttcctttctcttgtgctgagtgtccaagctgccttggagagtccaccgaatcttatataagcaaaagaaggccagaaaggtggggcaggctcttttagaggcggggggaaacatcctttgtaaaagggaaggaaaggaggcagtgtaaaaaccgcccatctgaagtccgtagctcaagcggcaaggtgtggaacgcagttgtgacagaaagcgttgccgcgtctagggaagagaaaaatg

SEQ ID NO: 8650 - DNA, 703 bp, Nannochloropsis_gaditana
tgcgccttggctgcgacatgccgatcaaaccgtgtccgtgcgtcgttgaagaacggcccttttaggtcgcaacactcatattaatgctgtaattcttacattgttctaacccaaccgtgcttgatatgtattatcttgaaattgtgccccaaaaatgacattcatcttaaaggtcgtgtcgtcgcaagagacgttgccgaccaacggccgttcaagagaagaaaaggtatctggctctcctatcagtagctccgatgacaactcttttgaaatgcgaagcataaatgtaccattcatgtttggaagggagctaactcacctgaaacgctctccatgctgtcatatcttgttgtgctcgccttgtcggtggcccattattttatttcggtgtgagcgagcctgacgctagcgaagggtgggggggcaactttttaggcattgtagacattgtcgtcgtacggcaatcgttcctatcgatgaatgcgttttgtgtatcgacgtctaatgcttttcgaatttgtaattgttgcttggatctcatatatacagctgaaaagggtaagcattcaaagtagagtggtgcgtgcttgcgtaaagcgaggacttccagggagtgcgtttactccttccccattaacatgctaagtatgaaaaacagggatttacctacccggcacttgtaccaaaaatgagttagaaaatg

SEQ ID NO: 8651 - DNA, 703 bp, Nannochloropsis_gaditana; identical to SEQ ID NO: 2704

SEQ ID NO: 8652 - DNA, 703 bp, Nannochloropsis_gaditana
gtggtcaagtaccggtttttgtccgagaagaaaacgattgcacgattcacatgtacgataataaacccgctggtattcaagacgaagtcaacaaggtattgacttcctcttcctttctttgccgccaagaagaacaagaggtaaggcgcaaagatgccgggcgtacaagacgcactttttcatttacaatgcagtatcaatcattccttccaatattttcacgactgttgtgaaactggaaggtatgtccagatacgggtgtgtattttttatgtgaatcttacgacttccacagaccttgaagtccgatcttgtcaaacttatccccaaatttaccaaagagaacttcaaatggtgagtaacatgcttatgtttcaaatgggcgaaacttatgcacttactagtggccctcctgctttcagtgtggaaattttgctttattcttcttgtcctctcgtccttatccacgaattcacgtctacttggttatcggtacgacatgatgatgaacagtttgtcattcacgtttcatccttcagcgatgtcgtatttcttcctgtcaaactccgagcctctattcgcatctcgcgatcatcgcttacttgttttgtaaagcgggacctgtgactttccttagtatgtccacttacctagtcctgtggtagtgacacactctcctcggctgcataccaaactcaggatg

SEQ ID NO: 8653 - DNA, 703 bp, Nannochloropsis_gaditana
ttggattttttctttttcaaatcctgcttttttctcaaagagcaccagcagttttattatagacacgcaggccctcagtcaagtcaggttttaatcttggagggcttcatgttggcttgcatctaaaattgccagcatacagtgaagcgcaagtagaagcccatgggcacatgtacggaaagaggtgctgattcgaaacaaactgccacccagaaggctaacaaacccacaaaagataacttgcaaagcccggatacatgtcagccagcctaattaagggagtcgttgttaacttagatggcccatatgcttggcgtacgagcttcacgacccgaaacatctggcaaccaccaaattgactattgaaaaagcaaacttcagtcttgttgggttaacgtcaaaactgcattgatctggatacttaatggtagtgaagagggtcttttaatagctaggttcactgaagatgatacgtcacatagcggtgcaggaggtagcagggttcacgcgatcggaaggacgacgtgcactgcacgggcatattttgctttcatttcttatcctcttctggatcaaatgtcaggatacaggagctggccgcggagagacatttgatttaagacggctgtcaggaggtgcagggatcggtagcatctacaacacgtcttagccttgctctccctcgcacaaccagaaaatcatg

SEQ ID NO: 8654 - DNA, 703 bp, Nannochloropsis_gaditana
agagatgagacacttaagtcataaagtattgcgacaaagccatgcttttcgtgattgttgcactccaattgcgttgcccttgcctccacccgaagcaaatgtggcgcgaaagctttaagataacttgatgcatctttttagtttagtatgagggtcctctcaagacacgacgataaacaataccaaacatcccttaatagtacttagaagatgcatgggactgtggtcgttttacaatcatagtcaaccaaaattggcctcgttgcgcctggtgcggaatttggcgcgaaaaaaaaagaagtagcaggtgccagtcgaagggtcttggtggcttgtggagctctgaaagtggcgagtctacctctacttttcggtggtgcatccgattcataagacctacgaatacctgtaaggattattcttgctgtctattagtgagtgttaactgtgtttgtcatgcttagctgctgaagagtatctcataagcctgcctccacccgtcatcgtatcgtgtctgatgcttcttctcacttgtccttgaatacgtactcaccataacaggtcgaggtttggcagcggccttgaagaggcaagcgcagtcaaatcaatcagtagaagttcgacgccggagtagcggcaggtagctattcgctcctgaaaaggacggggtgccgttacttccctcaggtttttcgagatcatg

SEQ ID NO: 8655 - DNA, 703 bp, Nannochloropsis_gaditana
gatgccaaagtttttctctatcctgcgatgcagtatcagcgcataccacaggactcgctccaggactattggttcccatcttgtgatcgttgtcgtgatgctggagtcggcgctgaccttgcgcgtgagctgtctgccagagcgccagaggtgcttggtgctgtactgctactctgtgggccatcgccaggacttggtgagcgattctcttaccaaccaggagtttaatgcctatgcgtgtatgtacgttgacattacatgagtgtgcacgagcgtagggtagtgaggaccattagagtggaatttcctctgtgagcgcaaggaggatgaccaaggcaggaaaagagcaagagcataaaagcggagaagaagaggggggaaagcggggaagaggagcacgaagagcggtagcaaataccacaaccacgcggcccctgcctgcgagttgccaatagcgataaattccaaacgatgccttgaagctgcagtatttgtgcctcggtttagctcatgttcgaaccttgcctcttttggccggggtatcagtgggaggaaaaggggccaagtgccgggtgacttttcccggcccctgaggcttcgtcctcttttttcttaacattattgacacccttgacagggagatctatgaaccaagagaatgacgatggagaggctgaggaggaacatgacgacatccgggatg

SEQ ID NO: 8656 - DNA, 703 bp, Nannochloropsis_gaditana
tgtccttgaacgggttgattttgcgggctgacatgtattgtggcaatgatcacgacgatgggctttgaacgagggccgatattgggtgatatcttggtccggggcacccagtggttggcgaggaggggcaaaattaaaggctctatcccaaagctgtagaaacctggaaggggcacagcagtacccagtcaccgaatccttttctctgtgatagaatatacggaagagatgagagcatgaagaaccacaggctgttaaggctatagtcaggcaaccacgccttcagaggagtgtcgctgattcacctgattacgcccggtgttcccatcccggccaaaacactgcgtcgccaagactatcagtttcctttgcagcgactaagaaaatcccccgtgacatttatttctccaccacaggctggaaggctcgggacgatgcggtcccgggtcaatttccccacgaccttgacggtctcgcctgatgatccacacccagatcagcgtgcaggcagaaagtcatgctggtttattacacgacgaggtagagtgccgtcatgggccctgggaattcgacgcctccttgatgttgactgcgcccttaacccatccacgcaggcacgaagtcgtttcaagtgctgaccatgtcgtttctcttgctgcctttgctggttgtgatcgtgcatttccggccccacgatccgatg

SEQ ID NO: 8657 - DNA, 703 bp, Nannochloropsis_gaditana
tactttcgtctttttgcacgtgtcagattgaaagctcggaaatgcatgtgtggggagcaaaagggttgaggaagggggggccatgtcaggagtaagcaagtcggttccactgtctgtctacctcccaaaccatcatctctgccccgttaccaaccaatcaaagttcgaaggatgtccctggagctatccgcatgtctttgcacaatttttattatttcatcatcctttctcggcagcgcgtgatgcctacctacctccccctgcaccctctcctcctcctcctcctcctcctcgcggccttctcccctccctccctcctcaccaaggccgggtgggtggaccccgacagcccacactcagtccagcgcacccactccctccgcgacccgaaccttccctctctgcgcctagtcatgtcggacgaatttaatgtggcagctcggacctttgcggacgggcacgaccctacctggaccgcgggggaccacagcgacgacgccaggaccagcgtggggaaaggggctttgatatattacaaccattcctacgcgagcaccaccgaagaggtccggggggggggcagtttggcatggggggactgggcggtgaggtgtttgccacacgtgcttgtccgtcttgtacaacggaccacgctgggccgctttctcggctcttggcgtcccgctgcctcttgactgaaatg

SEQ ID NO: 8658 - DNA, 703 bp, Nannochloropsis_gaditana
gcgagcggagataacgcaggaggatccttcgggaatggattagctatgaagcgattccgatcaaattgatgtacatcttcattcgcacctctatttttcacggcctccatctcgaaggagacggcagcgcttaggaatcgaaggcacttgtgaccaaggtgtgcgaagcgaactagatgcaaataagaagggaattagggaacctgtcaaggccgcatgatagcatgtgtcaaacctgtaatcacgcaagtgtgtgattcattaggaagacgagtggctcactcaaacaaaggtgtgtcctatacgataccagaggttgaagcgtcggcctcttttttcgcagcgatcagaacacgtacgcgttcgccccaagcgtctggatgctgaagcaagatgtcaccccttttcatcaggtcgcttatacagctcagtgcaaagacgttacattcgcctcacacagtttcgtgcgaagatctcccccccccattatcttcgctttgcgcaccgcatgtaagcctctgtcatcggacattccacagctctgccacggggcggcagcgaagcaagggaatcagcagaggtcgggtcgtcttggaagcttcttctacgttcctctctcgctttggcaactggcgttcccctattataaatgggaggtctacatcacgctgtggttgccatcacaggcatatgcgcgggaatg

SEQ ID NO: 8659 - DNA, 703 bp, Nannochloropsis_gaditana
cgaatgtggtatgtgtcgtgtttctcaatttcgacgtcaatccaagttgaatacaagccctcgaaactgctgtttgttttgcgcagacgccatatcacaaatttccaaaaatcaaacatcagtccaatcagtcataacatggtctaaaacacgggatttatccatggcaaaggacccatgcacctacgcaagctgatacacctccgattatcatcagtatgcatgcttctcacaccgccccaagcgaacgattccgaattcgacttacatttctaagaaccgtcacgactttccaacctttgtccgtcgattgctattggcttgaagacgccacgcaaaacagtatgcaatgcggtacaagttaatgggagtgacacgtcaacctgggaagaaaggttgtactgtgggggcagcaagacaaaaagttataacaaaaatatgagaagttaagaacagtccttaaaccatgtgaactacatgctgatgcacttgtgaagaaagcatatgtccgagtgaaatgaaaagtgagcattggtgtacataaacaagagggtgggtcgctttgctgggtgtcggcttctctgcaggcactgtcatcgtcaagctctcgcccctctccgctagccatgctgcaggtccttggtcctcctcaaggattatgcgccaacttggcatttctttcctacctggaaacccaaccatg

SEQ ID NO: 8660 - DNA, 703 bp, Nannochloropsis_gaditana
gtcacgaagtaaatcgccttccaactgctgcggcacgctcggcgctgtctcatcctcaaaatcaaagtaggatgcacccttttccggatccggccttcgccgccccacactcgcgggctgtgcgggtggcatgcctcccagcggagccgacggtagcggtgtacttgatttcgatgtcgtgtctacttcatctttggtgctcatcctaatcgcgatgttacagcgcctggcaaaagtgctagagctgaggcggcttctcggaatgataagaaacgcacggctcgcaccaaagctcgtgagcagggcgcctaataggcaataagcctggagaggctgcatattgagccgttctgtttcactgtaatacagattaaaaacgtgcttatgaacgtgtgatggcttcaatgcggcgacctgagacacttgcaggggctgactcgaaggtctcgtcgctccactttcacggcggcgatagatacagtcaggatggcaagaattgcagcacacatcgaaagcattcgcgcatcttaggccgacactcgcgcacatctcaacaagaccaaccagagcgaacggtattgatcctggctggcgcgattgcagcggataaacgcaataaggcaacagtcgacgcccttccatagaagatgtggaacaatgtcagctctcctcttcaattacacttcccaacactacaggcatg

SEQ ID NO: 8661 - DNA, 703 bp, Nannochloropsis_gaditana
acatagctatgcttccacactgccagcatgtgcgcgtcgttgaacccgttacggcgctcttacgtccaacaaatgcacggtggcagaatggtaaaattcagtgccgagtttgcctcgacgaggcattatgcttcatgttgacagggtacgaacagcgacaatgacgaagacgcccagccagcctctttcccgctcgaccgtctgcaaatcttcaagctcttttcttgtgaaaaaaaaaacatgtaaattatatgcgtcattccgatgaaattgtggtcacaccatatctttggcgtaggacgctttgaaaagatgcgacgcgaacggccatccgacacatgaagggcagcgagagggaggaagtatgtcgcggtaatctctgctagcacgaaaacggtgcgatgctcgtccgtgtccccagagacttatatatggcttcataaacatgttgaattgcgaaacgtatttgatggtagttttcttacccatcgataggatgcttacttcagatgactcaggggggacgcatgcttcgacgtctctaccctcaaccaggcctcgacggacgcgacaaagcattattagcaaattgaacgatttcgtccaccgcgattacatcacagacattgtcttttatggtttctggcttggcttttgggtgtttatgccccctgtcatactcttcggtacgcttctgctggct

SEQ ID NO: 8662 - DNA, 703 bp, Nannochloropsis_gaditana
agattgatcgaacagacgtacatggcccaacctaagacgtagaaagatcaaggaggttcattcttatttccgcattctcaggaggaccaggacggagggaggttgtctgcgagactagcagatgatgaaagtgtcgggaattttgtctcaaagtcttgcgttctgcgtactgtgtggccaagccgcggcaacagcttggggcaggcgtcgacagcaactactacaacatcaccgacatgccttcatcttcggcttaatgggcacatttcctcgagccggccggtatacgtccggttttctcgtcgaacagcgctcccgctgcttctttaccacttcctcgttgtcctcctctacattatctgcgttcccgtcgtctaactcctcttactcgtcctcttcatcttcaaaccctgcctcgtctcctcaccccatcttatctcctccgcgtcctctctcatcgtcttcatctcaacacgactcctccatcccgtccttgttggacaaaagcctattcgagagagagtgccacgtgcaagccttgcgccttcctgctgcctattgccaccacgctattcaatcgctatctccgttcctcttccgctccacaacgcaacggagtgtaatcctgccgggacgatgcacgctgccgctcgaccctccgcttaagccagacgaacgtctgctcctcttttgccctccaatg

SEQ ID NO: 8663 - DNA, 703 bp, Nannochloropsis_gaditana
agccgttagcggccgtttacttccctgaagcattcctgactgtggtctcggtaaaaaacatcccctagcttgaaaatcgacgattatgtataacatttcgttgttgttggttttacaggtccagcatggaggatggcttcaatcaatttttgtcttccttcctatcgatgcgagcttggcatattacagtaagcctcccatcaccatgcagcccgtatacctgcgacatagtgatacccagaacgtcatccctgcacataggcgacattaaggcagctttatttcataccttagcattggcgccccaatgtactgcttctgacagcggtcccgtcgcaaaaatggagggggcctggtgtactttctctgtcggccagcgtccgaaattcaacaaggctgcccaacgcactgacgtagacactttgctggcatacggctcacagtgctatagatttattattaaatggcctgggtgcgaagcaggtatgcacttgcacgaagatatttgtgtgccttttggacgccaccattggtacttggttcctctttcagacagtctatcctcgcgcttcctcatccagatgacgggaagaaggtgagatcaaataggttaacgatatcttaccccaggtatcatttttgctgaaggaaaaatcagcaagctttgatatcgtccaatctcccctcttactcctaaaatagg

SEQ ID NO: 8664 - protein, 1307 aa, Nannochloropsis_gaditana
MSGTTSNPHAPSSEAAVNSDGWKMPGPNMDRLATLLAHDRELQDAMPDPQVQARIDKTATTIELVQQVCEGYAEREALKWCVNGAPTADYTECLTYRDIWKRVRAMATVLSGRGWLLKKDFVAVCGFASPGWVLIDVLALYLGAVLVPLPLNVPYEDLRSMLEESEARVVFCAAEEAHTLVMNVLAKDGACPGVEAVVVMDYGEESNGQAMVQALRPVLPATVLRVLTLGELLTDVSQGIVDSTERYGTTAAASSCGFLPPAVPGSQGWSDESNPLLGLMYTSGSTGRPKGAMYTEKLMRALWHTGFSWGKGEVPVISLGFLPLNHIVGRVTIYQALSKGGRVYFVRRSDMSTLFEDFATARPTKTMMVPRIANMAYETYQLKKMELLQTVGLSSSSLPTEEQAQGKRLKLDEVERAAREYIRDRVFGGRLLFAIVGTAPSSAAVSALIQEACEMPMVEGYGSTELGGITIENRINVATVVKWKLIDVPELGYTLKDQPCPRGELLVMTTTGIPGYYKHPKATAELIDTEGFFHTGDIMEQRGPEELVWIDRRKNVLKLAQGEYLSISRLEALYAGDPDVKNIFLYGNSLRSYVLAVVVPSEALVAAAKAGLEDGNGGNGLKGSARDELAGQGEVEEEAVLARLKPLLRQRLDSMAKEAGMASYEVPRDFIVQLAGFTRENKLVTDSNKLARARLKETFGPRLEAMYDAVEQRKEKRLEHLHSDPQASTTDMVRAVLEMTLGLGEEVGLDATFAQLGGDSLSAVRVTEHLKRLCGVGVPVAELLNPAMTLSSLIQHLDLKLKRGQVVGAEDMEETGEEEIYRRVHGLGDDDAVIFAQDLTIGKFIPTAVLHPPEAKVATDWAAGAEKGFEKREGRVRGVLLTGANGFLGRFLLLELLQKLCAQTDYKLGGTGRVYCLIRGRDEAAAKCRLWEAVGASLLQAHEDRIVVLAGDVSRPHLGLSGDTYANLLENVDLVLHAGALVNHNLSYRSLFGPNVVGTANIIKFCLARPSHPKPLHYVSTIAVTMGEGGPGREVHEGHLGYCWGNQRFVRKGTYAEGYGASKWAAEVLLQNVHKETGLPVVAYRCSMILPHSSLPGQINVADVFTRLLAGVIYTGVAPASFTDGHGPAPAYDGSPVDFVAGAIVAIVWKGFHRSTGQVDVDAGQEIEASGCRLFHVINPHVQKGPSLDDMIDWVQSAGYDVERITPYRTWLETFESKLQALPSEKRNQSPLPVLKHWQDPSPSRIHAQEISVVDASRFRAAVKELTRWGDVPCLCEGYLLTCLYQMSKVGLISATPAVMLAKLAEK

SEQ ID NO: 8665 - protein, 422 aa, Nannochloropsis_gaditana
MTSTASLACGAYTAAVLVCLTTGDGVATRHIDANVGNRRTSAFLPVMPPMGTPVTGRIRSHPLEAHKMYYVCQGGTRLSQRRHERLGTRTAVMVVKTDVELSDKRDVDPEVGSSSKSTNHTGVSRFGSAMPKSAEGTGPPPAPQDNFKHKSLAGVPTDYGPYLTIKGFKINAFGFFFCFMAILWAIPWAVFLVVYKALLEFVDKLDPCRYNVDRSSSLWGWLTSLSTDSLPEMTGLENIPDGPAVFVANHASWMDVPYSAQLPMRAKYLAKADLTKVPILGNAMSMAQHVLVDRDDKRSQMEALRSALLILKTGTPLFVFPEGTRGPGGKMQAFKMGAFKVATKAGVPIVPVSIAGTHIMMPKEVIMPQCAGRGITAIHVHPAIPSTDRTDQELSDLAFKIINDALPNEQQCASTSKETGGA

SEQ ID NO: 8666 - protein, 540 aa, Nannochloropsis_gaditana
MKRGEPGTPIQFGDVAHVLRKNIEQIYGDEPSVDGAPLAEGEVSSMTDGTAFLGLYQYFKKYGPVYKLLFGPKSFIVLSDPTIIKHVLKTNNVAYDKGLLAEILEPIMGKGLIPADNETWKVRRRAIVPAFHQQWLEHMVSLFGECSDVLMRKLEGLAASKTDVDMENLFCSVSLDIIGKAVFNYPFDSVTKESPVIQAVYSVLKEAEHRSVTPLPYWNLPLANIFVPRLRKFKADLKIINDVLDELIEKARISRVESDLEDLERRNYENVGDASLLRFLVDLRGEDTSNKQLRDDLMTMLIAGHETTAAVLTWALFEISQKPDVRSKLQAEVDRVLGDRIPTLEDIKAMQLVRFSVAESLRMYPEPPLLIRRALEDHSLPKGTAGFEARIIRGCDIFISIYNLHRDPDLWPNPNSFDPERYLRPFINKEKYPEWAGFDPAQVTGLYPNEIASDFAMLPFGGGARKCVGDQFATLEATVTLAMLLRRFDFDFVGKPEDVGMFTGATIHTRNGLRMTPRRRTPSPSPVAAAVDRELQGLGA

SEQ ID NO: 8667 - protein, 597 aa, Nannochloropsis_gaditana
MPTPKTVLLLVLALILMANTHVFAFVTPASRPLKAPTNALRFTCPPVIPVRAPVFKPSRIYKLRPAFSAAVPAASDVPVPPMSPATDSSSEEDTSKSQKILERPFKGIVEDVHRKAPHYLSDFKDGANVKGVAAIFFLFFACLAPAVAFGGLMGKLTEGNIGTMEMLLATASNGIAYALFSGQPLTIIGSTGPVLAFTLVLYRTAQNLALPFLPLYSWVGIWTSLILFLSSVTSLSNLVNYFTRFTDEIFSLLISLIFLYEAVKDLSSFFINPSVGFAKALLSLVIAVTTFNTSITLAGLRRGKLFTKRVRDVIADFAPTIGVLAGCFLTALAKAKKAEALPTLLIPDSFSTSLGRPWLVNIFALPIWARWAAFIPALMSSVLLFMDQNITVRLVNSPSHKIKKGYGLHLDMFVVSILTFINSLFGLPWLVAATVRSLNHVRACARFKSTEDGEVVIESMQENRLTGLAIHSLIGVAILGFRPLLGQVPLAVLMGLFLYLGKSSLAGNQMWERLKLLITDPAQRPKAAWAQKVPFKVSAAFTGLQFACLGGMWALKSSPIGVLFPLLIAALAPIRVAIEKLGWFDKKDLEILDSEDD

SEQ ID NO: 8668 - protein, 312 aa, Nannochloropsis_gaditana
MLFRSGARILGAVRQSRCRLQSTFSQHSLSSSAMSPPSSPPSEEPEATTDPILVERRALAGTKGGYLLVTLNRPRHSNAMNNATLQELQAVFDRLPADKWVRAVVLTGAGHAFCGGHDLYQMHDSQGDKQYFERMFARCSRFMLSIQRVPQPVLAAVNGLATGAGCQLVAACDLAIASSHAQFATSGVKLGLFCATPSVPLSRNLSRKRAFEMLVTGKYIQAEKALDWGLVNSVCPHEELEATVLRLVTEIAQNPPVAISMGKRLFYSQLEKSSIAGAYDMADYVMSTNMTEADTEEGIAAFVEKRPPTWNL

SEQ ID NO: 8669 - protein, 316 aa, Nannochloropsis_gaditana
GHHHQHEHHHSTSRGDEHCDAHNKVVEDQRKHIHDHDYHHHHHHHYHDNSMSAQQKGDHLPSKRHSHNYDEHGHTHEPMESPGAFHTRDQPLKRDYLERAFTVGVGGPVGSGKTALLYALCKALRHDYSIAAITNDIFTQEDGEFLLRHSALEPDRILAIETGGCPHAAIREDISANLAGCEGMTGKHNADIILVESGGDNLAANFSRELADYIIYVIDVAGGDKVPRKGGPGITQSDLLVINKTDLADSVGADLERMAREAAVMRGDGPVVMAQVKFDIGVQDIIAHILKAWKLATGVIRPKKTSGIRDVAEKSS

SEQ ID NO: 8670 - protein, 2980 aa, Nannochloropsis_gaditana
MPVDEPIAVIGASIVLPANINSRERFFEIIREKNQVSVDTVAAGRYHASDIDDSDSGHPWKLKSKYSMIFTEEELGSYDSHLFNIQGKVSRNMHLQQLGVLQSAFEGLEDAGIPLHDIYRTRTGIFVAAYTAFLPACDGPDETLLRGQIMSSLADQVSYFLGTYGPSVTLETACSSSLVAIAMAVASLQQGDCDTALVTGLNYLNEKDFHLSLQACGVMVQGPTSHPFDEDGAKGYIRGEGMGTVVLRRMADAEKHGDRILCKVLRAIAASAGPADNALEGPGRVYEQPCPYGMREMFSRVYKCANVPLGKLHYMECHATGTAVGDVIELQAIGDVFGDSHELRKNPLRIASVKSNIGHAEVAAGIFSVIKIVQMMKHRTFLPSAGVTCPRKDFEWVKHNMIIQQECEPFPDNEPVTVGINSFGIGGAYGHVVMQEYTGPEPVRRALLTSASSLWALPVEDAAAKGLVFPLSAVSMPHLQLFADRMAKYIKERGPTISLKDLCATMWIHRSRFQYRKSFVASTTQELAEKLAAFASSGNTEPSGEGRKMQVAYVFTGQGSQWPGVGKTLMAFPVYRKAVKAADKLFKSKSGWSILEKIDTLSADEMRDTLYAQPISFLVQVGLYELLKFFKVFPDVVVGHSAGEVAAAYASGLLTLEEACEVVYHRSAEQQKMAGCGRLMAVGLSEEKIQDIIRGMADVEIACVNSPESVVLASSEECLKEVGELLPEGTQKAMVPGNIAFHSSRVEPILPAMKARLAFLDKRPKTWGLPYVSAVTGKLESKLDSNYWVDNVRRPVLFQKAIETIFSQDTGPDIVIEIGPHKTLCSPIAQVLSAMGKSAAILCPLKRNDTCSMRFLEALGQMFEKGLSVDCKQWYQDLGYAFDEDLPKHPFIKKRLHELHPVLKNDMRNGLYIDGPVAGVQKFFDGAYVSEVSDRTYKQMCDHKMGGQAIFPGMFFVEMVLEAVKGAPITLTNVEFKSMLKIPSASSGENPSLIALNFAEEQDGIRSFVVRSCPTREKWDEEPVLVEHCTGKVVKADLLNEDGSIKDGFKPEAYGLLAGLELKDIGDGGLKDLIGRHTQCEHSSTENFYGTHCVEGQMEYLESFQLVESVHVDPKTMSILGKLNYDNEAWEKKGGIFGVQLLDALLHQTLILATHSAIYYAGGFDACHFLRQPATKELYVYFTLDKYRLQIGRKKKVGDFALYDGTGRLILYMQGFYTVFASFSDNYKLCDLLWQPFAAPMPPPANELIAYSEEALAHTADWTSSDNSCMTAWLVERLRSNGALELPPPVGDAHANKSRKVKEVVPLVRKVLEALEARLSEVHDSAITDKVPAIPKVANLHERPEELVKTLTLKIQEKKVPAAEEGGADLVELTADEIKELVATSVQRSAETATVAAALKAQMEAQLRLLGHNCVFRVFEITQEATETVVEALSRLELPAHIIVEYFVGSHNSGLLKSLATKINRRATNIRLRRVLINDMLFNEIKDITFEAVIFDEWTRSGAAAYAEGRFESPAANALEALRTFMMPGAPVFVRGLHDLPLWVPLISLASASQLPLINTLSAEEAVADWTQQLLAHGKVYSTEVGATCVLIGEQGPALPRAPSRYLLFVDKQSHGEEFGRLLRLDHALAEAEVVLVGESGQLTDESTADDYAALLAKVLAPQTGEELPEGDDIAHEEEEVPNGTPFKGVIFFAGLHDTSVIGDVAFSRLLKLAQGLLKNGDLLKTLRGSELAEPNSLWVITKGAYVGDVCPAQGTVQGLATVLCGELPDMVTKHVDLASSNSKDMRCLSKLVVEDSREKSYTVMNGAAQVARFNAMDKTNARAMQVLATDPKLSYFADITSAASVPGEINVTYQLRDVPPPKENEVQIDICAAALNFRDVMIALSLLPEKSYERSYYGRNLGLEASGVVSAIGRDVKDLKVGDRVMTGEPRCFANRLNAPASRVVKLDQRVPFEDAASLQSVYNTSHHALINLARIRKGETVLIHSAAGGIGHAAISIAKHVGAVIHATAGTDEKRQLVKDMGVEFVYNSRNVGWFDDLMRDTNGQGVDVVLNSLAGKHQRLGVQALRSSGRFLEIGKMDIFDNNGLPLLAFRKNISFFAIDMDRLALDDPAQTAEIGREVGMHFMEGHYDKLPIVTFPMNEIKEALEFMKTGKHVGKVVLTNYLEDKKTGKVSPCSVTVEKPQNIFHADATYLVTGGAGGFGSKLVRYAYYNGARSFLITTRSADTEKVRGLFRDILDDASVKMEVMTVDTGSEADMKKLTDRAHGISPPVKSIFHVAGVSVDIVLPEMKPENFYEVANCKALGAWHLHKGTLDLPIENFVVVSSIASLIGGLGMSSYASSNAYLDALMRARRSQGLPGAAFNMSSLSDVGILANNLSARKFQLKMGVEYITSFRALQELEMGLVAGMNPIITMFFKEKTRTMFPFQSPWSYHLGEALTLGAVAAKGDFMTTKEIAHFLSEEIKEITGASEVLVTSQLVTLGLDSFGFVELGGRIKKHFGIEVSSVKMSPDNTLEDVSKIIYKLQSRGSNDKKGGETADENDNHEEMMVLHNKAEMNSMLATLFEEDDDAANNHKAFHLRPLTSSAKLLFGATGLTGSHLLRYMIKAGVPKVFCIVRGSTSEGGLARIEKTMRLLKIWKPSFAANIVVIPGDMALTNFGIKPDMYARLVHEVDAVMHAGGSRKWHMDTESVACNISGLMNIITLARKNNASVHYVSSGWLDAEEAATESDRAILRGMPYVQIKRRAEDILHFAARHYKLACFAYRIPLISVNTKCGFTGDFVAFSVMQTLYESRMMPKDMCESSCYPIMPADLAAKYVVRQMSRAPRKTNGKALLYSASAFSEIVSTEKLAEWVEELKNVKISRTATMEQVKEYYAKRLVNEVQDMQASFTDFLVALGRASERLRLQVRRESSLRFLVDKALYFNTKVPPSELLRDYIKNHPEVLLMEQAWFVDGEEDEGRDAEEGPGKDHPAEKDVA

SEQ ID NO: 8671 - protein, 203 aa, Nannochloropsis_gaditana
MQSPSRSMNSWVPKDRRNMLETLSTATQHLEDLGIEEDAHGFQEQQEQQRRWRRQQQKPKEYKVGVIVVDHGSRRKEANEALESVASEFKALSGYELVEPAHMELCEPSIATAFGRCVERGATFIICHPFFLSRGRHVAEDIPNLLEEAASIFPGVEWALSQPLGLQADIPRLMQQAVEECIAEKNIQSEDHADGLPMPEFNI

SEQ ID NO: 8672 - protein, 1536 aa, Nannochloropsis_gaditana
MYRALRSPLGSRAAEVLQLHHVGASKRLVPAGFSTSFGNQGIKSVLLRRLLATQSDGAASPPTKRAWLVLEDGTRLQGYSFGADKPMNGEVVFSTGMVGYTESLTDPSYRRQILTLTSPMVGNYGVPDPKVLDELGLPKAFESYKIHAAGLVVQDYSHHYSHWNAHFSLGDWLKQEGIPAICGIDTRMLTKKIRSHGAMLGRIEFEDGPKPELEDVNKKHLVAEVSAPEAKVYGKGNPIKILAVDCGIKYNIIRHLVRKGAEVKVVPWAHDLVSEMAHHQGLFLSNGPGDPSMCTTTVQHLKELVNDPNFTKPVFGICLGNQLLGLAAGAKATKLPFGNRGQNQPVVNMLTGKAFITPQNHGYAIDDTTLPTPWKPLFRNLNDHSNEGILHTQKPIFSAQFHPEAAGGPTDTEFFFDVFLDTVREQRKTIVFPPVKPTPARPEVAKVLLLGSGGLSIGQAGEFDYSGAQAIKALKEEGLEVVLMNPNIASVQTNVDAKSDAKADQVYFLPVNPDYVEQVIKRERPDGLVLSMGGQTALNCGLALHHKGILAKYNVKVLGTQIDAIEASEDRQLFSDKLNEINEKIAPSITASTIAQALTAAEKIGYPCMIRSAFALGGLGSGICRNPEHLEEMAAKALSLSSQILVEKSLKGWKEVEYEVVRDSADNCITVCNMENFDPLGVHTGDSIVVAPSQTLSNEEYHMLRETALKVVRHLGIVGECNIQYALDPYSLDYCIIEVNARLSRSSALASKATGYPLAFVAAKLSLGITLPEIQNSVTKSTQACFEPSLDYIVTKIPRWDLNKFQGVATEIGSSMKSVGEVMAIGRTWEECIQKAMRMVDPAIEGFQVRKRYDDDSALLYELTNPSDKRLYAIAQVFAEKTKTVEEIHELTAIDHWFLRRLERISKQRDVLLKHGNGKGALDSLSAEELAMSKKLGYSDRQLGALLGTTDDAVRAKREAAGIVPSVKQIDTLAAEYPAKTNYLYCTYNGSEDDVVTGEGGVIVLGSGTYRIGSSVEFDWCGVSAIRALRGMGYRTTMVNYNPETVSTDYDECDQLYFDELSKERIVDIYQREGAQGVVVSVGGQIPNNLAMPLHKVGVKIMGTTPEMIDQAEDRFKFSALMDSLGIQQPAWKELADTKSALAFAKQVGYPVLVRPSYVLSGAAMSVAFNDEALLRVLSVAADVSQEHPVVITKFVNGANEIEMDAVAQDGVVMAAAMHEHVENAGVHSGDATLMLPPQRISAYTAMRVNEATRKIAKALNITGPFNMQFLSKGKDVSVIECNLRASRSVPFVSKTMGVDFIEAAARCMVGEDVTGMNLPQLGQTGRPKGYVGVKAPMFSFTRLRGADPVLGVEMASTGEVACFGANIHEAFLKALISTGFKVPEKNILFSVQDSLRDDVIHAAFQLHTLGYNLYATRATHDFLLSCHVPCHLLHYPNQPEKHPNVLEHLKNGKIDLVINLPTPESKQVENNYLMRRTAVDFGVPLLTNIHLTKLFAEAMTKYKKGELIGIESQNLFDYYNAEAPEEAWTSPSEFH

SEQ ID NO: 8673 - protein, 304 aa, Nannochloropsis_gaditana
MKWILREGIDFQPEGPNSRGSTFTQLFQVIPAIEPFYMEWEKKYDSSPVYEWMKSVPWVPIAGVILYVVGIFGGQALMKNRKPFDLKWPLAYWNLALSLFSIMGMVRVVPHLIYLTATKGLGVVACGAPEPLYGNAAVGFWVQAFILSKLAELIDTAFIVLRKKPLQFLHWYHHVTVLLFTWFCYTHENPGIIFVAMNYSVHAIMYGYYFLMAVRVRPSWLKPQFITLMQISQMVVGVATAAFYIMKIRAGEECAVDQDLLVACGVMYSTYLYLFCEFAVRRFILGPKKETAPGKAGVSKMKAQ

SEQ ID NO: 8674 - protein, 171 aa, Nannochloropsis_gaditana
MADGDAAGAEWRGGQAASAVSKDLKTLLTNENVASILPHRYPFLLVDKVIEMEPGKKAVGIKQITANEPQFTGHFPERPIMPGVLMVEAMAQLSGVLCLQPPVSDGKGLFFFAGIDGVKFRKPVVPGDTLVMEVELVKFMESFGIAKLKGKAYVDGDVAVEIKEMTFALSK

SEQ ID NO: 8675 - protein, 340 aa, Nannochloropsis_gaditana
MVFQLARDALSALVYHYKEGNLNWPMIIYLVLAHLAAYMGLVSIPSCKWQTLLEAFILWPITGLGITAGVHRLWAHRSYTATLPYRILLMLFNSIANQGSIYHWSRDHRVHHKYSETDADPHNATRGFFFAHMGWLIVKKHPKVVEGGKQLDFSDLAADPVVRFQRDWDPWFAQFMCFVMPALVARYFWGEAFWNAFWVAGGLRYCLVLHFTWMVNSAAHLYGDHPYDPTIWPAENPLVSVVAIGEGWHNWHHRYPYDYAASEFGISRQFNPTKAFIDFFAAIGMVSNRKRATGAWAKLRESRAKDEANGKSIKDFRGRGVVQGTAQPPGWEQSAHPKYN

SEQ ID NO: 8676 - protein, 239 aa, Nannochloropsis_gaditana
MVGHANRILYEVTHEHARQDKLVLTLGGDHSIGVGSVAGALKGRPETAIIWVDAHADINSRNTSESGHLHGMVLSFLMNLDNSRNMKGFHWLNDESIPVLLPTRLVYVGLRDLDKGEKAFIRSLGIKAYTMHEVDKFGIGKIMEMVLDHILGRTDRPLHLSFDIDAVDPLYAPSTGTRVAGGLSYREAYYICEEVAHSGCLASMDLVEVNPTLTMAGGDERTVDMAVGLISSATGNSIL

SEQ ID NO: 8677 - protein, 878 aa, Nannochloropsis_gaditana
MFFITEMHRAWRPPLFSPRLDSVYGLETSPKLHRFKCVSSLSSWSSVDGGNGSPSPTTASASGLAPPTDPTRPPTLPSQEFRPKQSLGQNFLSDQNYVLKIVQSLVDKSPGGRRVVELGPGPGALTRVLHRRYPDMLAVEIDPRAVALLNEALPSLKVVQSDVLQVDWTALAELRGGPLSVIGNLPYHITSQILFCLLDNHRTVRQAVVTMQLEVAQRIVAPTRCKDYGILSVLFQLYTRPRINFKLPPTVFYPQPKVTSALVTLDFLQPVHGQPIFDVEPGALKQVLNLSFQQRRKMLRQSLKGLLASRGLTLDEEWATKRPEELEPAQFVELTRLLFGSATEKHHKGSEDNIESEERHLKQEQTPHATISLMVANSGWRCRSKLGFAFSLTSTIVLISAVLLLCGQPCFGFGALLRHSPGVFKSNTLLGTRRLSPMQSTLSDDEIAVVTQAESAVNAMFKRPLRVGLLVEPTPFTHVSGYANRFKEMLKHLHRTGDRVEICTTDDVPSAPPKFLDYRINYTPGFRFPLYDHISLSLDVKLVAYQLLKVFRPHIIHVSTPGFLCFAAAIYARILRIPLLFSYHTHLPIYARDYMGFIPGIVSLTRFVIRVVHNWADLTLVTSPQLKDELESFGVKRVAVWKKGIDTDRFHPRFRDADMRTRLTDGHPEAHLLIYVGRLGAEKKLKTLRGVLKRIPGARLALVGGGPAEGDLREYFKGTNTVFTGLLHGEELSKAFASADVFLMPSDSETLGFVVLESMASGVPVVGARAGGLPNVIEHGKTGFLVPVGDEPAFAARVQQLLGDRGLMRDMMAAGREEAESLDWASAMDHLRNIHYKRAVMIHRRRTLSAFLAWAGTFKERTVHNLKQSMEGMFATAT

SEQ ID NO: 8678 - protein, 784 aa, Nannochloropsis_gaditana
MTTQAAQVFWYPFTQHSGLSGTDLHVVDSAYGDNYTLISKSSEDGDAKERVPCSRTLIDACASWWTQGLGHGRVDVALAVGAAAGRFGHVIFPGNVHEPALRLAELMLAGPGQGWASRVFFSDNGSTAMEIAVKMALKKNSVDLKYEKGCSKEEFRVEQPNDKISATPLTVVTQRDCYHGDTLGCMDAAAPTIFNTGQHPWYQPRTLSLTVPTFGYVSGHLQVEIPPEITRAAGQSALQLPDSGQVLKFPGGLATLLDVHAREGSDAAVIYRKAIRAQFIAFERGEEGILSSNTVIPLRGEAGQGHRCRKLGAVLLEPVLMGAAGMVMVDPLFQRILTLEGRAYGLPVVFDEIASGLYRLGCASAAELLGVAPDIACYGKTLTGGYLPMALTLTTEAVFEAFHGTNKSDALLHGHSYTANPLGCAAAVSSGGTFECLVDTLDRVLRRRGDTLGGVWVPQMARPRRNRKSETLRAMVRENIVLPRNFIYPLFIHEERYETEIPSMPGQKRFSLAGMMAEVAESLQFGVKTFVLFPKVEDRLKTNDGREAYNPAGIVPRAIAMIKDRFPDVTVMTDVALDPYSDQGHDGIVLNGKIINDETIEQLCKQAVCQARAGADIVAPSDMMDGRVGALRRALDSEGFTDVSIMSYTAKYASAYYGPFRDALDSHPGFGDKKTYQQDPANGREALLEAALDAAEGADFLMVKPGMPYLDVILRLKQATNLPIAAYHVSGEYAMLKAAAERGWLNEKDVVLETMTCFKRAGCDIILSYYAKMASKWMIEDGLI

SEQ ID NO: 8679 - protein, 327 aa, Nannochloropsis_gaditana
MDLKSLLNVTAVDFTEALKTQPALGQLLFGVGAVLVLKFVLSTFQAFYRFFLRPGKKLRKFGEWAVVTGATDGIGKAYAFELARQGLSLLLISRTETKLRDTAAEIKSKYPNVEVHILSIDFGNFNEDAQAKVKQATKGLDVGVLINNVGQSYDFPMYFDELSDEHVHALVDLNVTSTLYMTRLLLPSMVAKRRGAVVNLASAASRNPSPLLSLYSGAKSFVELFSQSLDAEYKGRGIRVQVQTPLFVATKLAKIRKASLTVPSPAGYAKAAVRFIGYEDSVSPYWSHAFQLYLMSCMPKSLLSIIVLNMHAGLRKRGLKKKVQKSA

SEQ ID NO: 8680 - protein, 370 aa, Nannochloropsis_gaditana
MGSHGIPVDERLRIKRAYGRVDRTALKNELRTRALDGGAILLAKALDAESVVHDEEGSLLRLDDGTRIAYGIECEVDMCPYGEDAMTLMDYRTDYLDNQAAEVQMTAAREPTFMYAMPMGPTRDGKKTKVFFEETSLVARPPMSFDECKKRMELRLKHLGATVLNVEEEEFCYIPMGGAIPVRSQRVVAFGGAMGLVHAATGYQICRSMAAAGPTAKAIADELKKASYNPDAAARAVYDSVWTRTTRLQRDFVIFGGEFLMAQHADNLRGFFDSFFRLPSLMWTGFLAGWPGLPNNEQHETWDKRLEFGISLWLLAPLSLKLALAAAGVTKGGLPFIRSVTPLADLPSFFELEKTGMSDRSELMKFDSIS

SEQ ID NO: 8681 - protein, 291 aa, Nannochloropsis_gaditana
MSIADEALFHSCLALVMLASGFGTAFILMMRPAPYGRYSEARGWGPLVNAKLAWFLMESPNVFVTAALWLWGDKAATRSVANRALVSLFLLHYVNRAFLYPLRMAPSRPMPLSVMLMAWTFCSLNSYLQARSLSRLHVFPGHWLSHPTFIAGLGIFFLGFYINLDSDHILRQLRDGMPRGTDKEAPNSRTRPMASHGASFPKPEDFQLAARPYSIPRGGLFEYVSAANFLGEMVEWTGFAIACGGSLASVTFAAFTVLNLAPRAWHHHLWYRQYFGHKYPPSRKALIPFVI

SEQ ID NO: 8682 - protein, 649 aa, Nannochloropsis_gaditana
MPKYTTTVASGEVDLRIEKEGPGSWAPKTVFQVFEETVKKYGDSPALHYKKVPHGGSLATTEWSSYTWREYYDLTLEFCKSLLSLGFPAHGAINLIGFNSPEWLIANCGAIAAGGVGVGIYTSNGVDACKYITEHSEAEVVVVENAKQLEKYLKIAKELPRLKALVIYSGTAEGYKCDVPIYSWKDFMALGSGVKDEAVRARIEAQRPGHCCTLIYTSGTTGPPKAVMISHDNLTWTVKNFVASLPFTLTCEDRSVSYLPLSHVAAQMLDIHCPIATGAKIYFAQPDALRGSLPVTLKDVCPTYFFGVPRVWEKIYEKMQEVARSTTGVKRALAQWAKAKGLEKNRRQQYGCGGGAPVGFGCAHALVLSKVKAALGLHQTKMCITSAAPIAVEILEYFASLDIPVLELFGQSECTGPHTSNFSYAWKIGSIGRDIPGVKTKQHANMSEFCMYGRHIMMGYMKMEDKTQEAVDNEGWLHSGDVAQVDADGFWSITGRIKELIITAGGENIPPVLIENEIMSALPAVANCMVVGDKKKFLTVLLTMKAKLDDQGNPTKELNKEALDIGKEIGSNASTTEQVASDPHWKKYFDEGLKKANSTATSNAQFVQKWSVLPLDFSEKGGELTPTLKLKRSVVAEKYADVIADMYKA

SEQ ID NO: 8683 - protein, 321 aa, Nannochloropsis_gaditana
MHRLRAIQKPGEAKQKSRKDVITQGLAALASGLTIVSTGSVQARVPSLNASGGLTGGQGKKTILITGANSGIGLDASKKLAAAGHDVFVACRTLSKAKEAARVSNAAGAFECDLSSLSSVERLVEAWGNRPIDALCLNAGVAMSTSETMPHFTAEGFEETIGVNHFGHFLLAQKLLPNLEKSSLAHPRLVVTASSVHDPSTPGGNVGPGATLGNLKGFTDFLEKGKRFEMVDGGSYSGDKAYKDSKLLNVLFTQEMSRRLLDRKKAPELEDTSAVFLATPPGKPKDLFSSQTISKEAQDTAKAQRVWDLSEKLLNKVMKAA

SEQ ID NO: 8684 - protein, 445 aa, Nannochloropsis_gaditana
MKSSNPNSNSMEGQKSTRLDAAATMDPPTTGSGLRRRIRPEIQLPAPHVNDKPDVKLGVLLLQLGGPERMEDVEGFLYNLFADPDIIRLPGLISGLQKPLAYVISKRRAPKSKAAYESIGGGSPIVRYTQAQAEGVERVLQEMGLDAKCYVAMRYWHPFTDEAMEQMIKDGVNSLVIVPLYPQFSISTSGSSLRVLQDLFFKDSPRWNQVSHTVVPAWYDRPGYVQAMGRLISKELAQFTQEQRAEGGLHVLFSAHGVPQRYIEMGDPYQQQIQQCVDLIAQEYAAPDVTTHLSYQSRVGPIEWLRPYTDDTLEELGAAGVKNLVVVPISFVSEHIETLEEIDIEYRELAHENGITNWRRVPALNTEPGFIEDLAHMVVEALQEPAISVTEACALNNLDIMPMGGDKDGGEDGKGLDGRLAVLGLASGVVLDLFSGRGGLAHLLH

SEQ ID NO: 8685 - protein, 398 aa, Nannochloropsis_gaditana
MAIIQHIPGALKARGSALVALVQNELWDPLAFACIVAWFCFQVVLERLLPGEVALGVPLLGAEGLRLPYKLNGHLAFWISLLLLVHGCPRFAVPVEDEGILPTILYDHFPQFAFAAVVFSFGLSLLLYLASFRKGARLADGGRSGNVMYDFYMGRELNPRLGSFDWKYFCELRPGLIGWVALNMGMLMKQQQLQAVTGEPPSWPLVLVNVFQGWYVLDALLNERAILTTMDITTDGFGFMLAFGDLAWVPFTYSLQARYLVGRPVSLSTYALAGLSAMHLVGYWIFRQANSTKDAFRRDPTSVPHVRYMDTIRGTKLMVSGWWGWARKINYTGDWLMALAWCGLCGPTHVLPYFYAIYFGILLVHRAARDDHLCSLKYGADWQKYKKEVKWLFLPGIY

SEQ ID NO: 8686 - protein, 293 aa, Nannochloropsis_gaditana
KNDKLRRILESQKITALEIPCIAHCHAEGYAQLKETLDGEAFDYIVITSPEMPLSAFLLHRVTKAPTALPGLLPPPPQAAQVFLEAARTCTLYKPTNLVSIGEATGELLKKAGASIVFTPSKALAKVLVVELPEVHEERGGMRRRKTAKVLYPASKRAAGTLEEGLQKRGLWEEVVEEEGEGMGGEKQSGRLFDVIRLNTYDTVPADWTDEEMSLAQSCAVVTFASPSALKVWAARLGMDFNMACIGETTATAAIALGWDESRIFYPKDAPGIDGWASAVMDALEAKDEEVAG

SEQ ID NO: 8687 - protein, 452 aa, Nannochloropsis_gaditana
MGRGGEKTVTPPSKTFHAHGHSLTASDLSRADAASTISSSVRPSKSLEAMPTEELRKKALQYGHDASADRASLLQILAPYGDILLRTDAPPSLPLTPPPFTLADIKAAVPRHCFERSLTTSFFHLACDLVLVALLGYLATLIGHPDVPTMSRYLLWPLYWYAQGSVLTGVWVIAHECGHQSFSPYERVNNLVGWVLHSALLVPYHSWRISHGKHHNNTGSCENDEVFAPPIKEDLMDEILLHSPLANLAQIIIMLTVGWMPGYLLMNATGPRKYKGKNNSHFDPNSALFSPKDRLDIIWSDIGFFLALAGVVWACTQYGFSTVGKYYLLPYMVVNYHLVLITYLQHTDVFIPHFRGAEWSWFRGALCTVDRSFGWLLDHTFHHISDTHVCHHIFSKMPFYHAQEASEHIKKALGPYYLKDDTPIWKALWRSYTLCKYVDTDKNAVFYKHRAS

SEQ ID NO: 8688 - protein, 459 aa, Nannochloropsis_gaditana
MARDGGILSFLPPGIPTDTRGIEVALGGGEGGSMPLRAAGVAGTSEKRKKKVLILMSDTGGGHRASAQALEAAFNELFPNQVECTTVDIWTDFAPWPYNRFVPAYQFMAKNPLYWKAFWEYGKFPPSKWGTEELSNLACHHRFKDCIEDQDPDLIISVHPLCQDVPLRVLNTLGRGKRQIPFVTVVTDLGGAHPTWFHKEVDLCFVPSDPVRKIALAMGLKHDQIRQHGLPIRPGFWKAGKDKGQLRRELGLATGVRTALVVGGGDGIGNLLEITESLASALAAGGSGGKKSQVVVVCGKNEEMRRNLERRTWPPSVNVVVKGFVNNMDAWMGASDCIVTKAGPGTIAEASTRGLPVMLFNYLPGQEEGNVPFVVENGFGDYKKDPKAIGEVVSGWLMSEEVREKMSKKALEASRPSSTTNIAKEIGDLLFGNWQLPLRKDTEDKFNILLKKLMEPVTM

SEQ ID NO: 8689 - protein, 331 aa, Nannochloropsis_gaditana
MACKVTISLLVLLSAGQAFNLRPPGVSPNKPGTWAPGVCLRPTWSSHIPRSASSTPLLPFDGFQPPLKDPVAAYDSAVKQGEKKANEPAPIIFLLGIQAGLQVGIGAAMAVATMAGVPGIQAKDPGLAKLIYGFCGLPCGLLMTATMGTMLFTGNTAVVSVALMEKKIKLQQLVKTWVWSYLGNMVGAGFLAALCTYAGVFSSSAAAIASVAASKTAMPFGVAVARGILCNWLVTTAVWIAQAAADLVSKATAIVLIITIFASLGFEHSVANMFVGPFGALNGGPSFLHFFLRNLIPVTIGNIIAGVVMVAFANYLSFGSGGKRWRSRSKD

SEQ ID NO: 8690 - protein, 289 aa, Nannochloropsis_gaditana
MGAQVSEEVPAAKALFEKASEILGYDLLDRAMNGPKDLLDSTAVSQPAIFVASAAAVEKLRATEGEDAANAATVAMGLSLGEYSALCYAGAFSFEDGVRLTKARGEAMQAAADLVDTTMVSVIGLEADKVNELCAAASSKSGEKIQIANYLCPGNYAVSGSLKAAQVLEEIAKPEFGARMTVRLAVAGAFHTEYMAPALEKLKEVLAKTEFKTPRIPVISNVDGKPHSDPEEIKAILAKQVTSPVQWETTMNDLVKGGLETGYELGPGKVCAGILKRIDRKAKMVNIEA

SEQ ID NO: 8691 - protein, 689 aa, Nannochloropsis_gaditana
MVYVPHRKKFYSIEVPNTETATAGPIRRFPDGEINPQLAYDGCYTIYELFRRSVAIYPHRPFLGHRPIDSEGHAAPYVFESYEEAARRIDNLASALEHEGLCPPTPDGLRLLGLYMKNCPEWIIADQAAFTLHGATVPLYDTLGPDAVGYVIKQTELAAVVCGPQELENLVAAAPECPSLKAAVLTCSVLSDHHRALARKGGLKLYSLMDLEKLGFRYPQPHFPPDPDDVATFSYTSGTTGGPKGALLTHRNFLTVYCAGKALEVENFPDDIHFSYLPLPHVFERVMLLAVLGNGAAMGFWQGSPERLVEDLQALRPTCMPAVPRVLNRMYDKVMAGVRAASPLKQMLFQRAYAAKLRDLDERGELSKGVWDRLVFAKVRRAIGLDRMRVMVTGSAPIAPHVLQFMRVLCACPIHEGYGQTETTAMTSLTFPGDWTTGHVGGVAPVSEVRLVDVPEMGYLHTDRQHGSAGRGGGAFGKAAQPCIGRGEICVRGPHIFKGYYKQPDKTAETIDAQGWLHSGDVGMWTPEGRLVIIDRKKNIFKLAQGEYVAAEKIENVLMQSEMIAQAFVYGDSLKSELVAIVVPDAEAVQDWARQESLPVDHSFAELCRQSLLKEKILDEIEVQSKRAGLHGFEIPKAIYLESEPFTGANGLLTPTQKLKRMQARDRYSTIIQELYATRDLHQGSKARL

SEQ ID NO: 8692 - protein, 270 aa, Nannochloropsis_gaditana
MREEEARKWLSVKRKDFARVRLVCFPYAGGNSNFYKTWDVKEAEMVTVELPGRNARYNEKVITDVYLIAKKIAAALAGLGYIESKIPLVFFGHSFGAIVSTLVAQILRNQYNYTPKHLVVSGCVPLHLRAGRPKFSVANDDELVSSLLDMGGITKEMARNRDVVTQFLPALKGDYLAVDKYVYHEAPPLDCPILALGSDQDLRVPQHETEEWARFTTKEFESRIFPGGHFFLKPLEKEVVAYVSSVIFRDLTGPGATDLPGFILFDPNKK

SEQ ID NO: 8693 - protein, 337 aa, Nannochloropsis_gaditana
MTGSVGTSVKPSISQQNHEVLERIRHHLDDQEHKIHEQLNRFQLIKKAVERICKNDDAYMQSPDIVKAQTTLEDSPLERKGNTAAEALELLKAGNAAFLRDEVPAKQCSDRHIGLHFAQKPHAIIIACSDSRVPPEMIFNCAFGELFVIRLAGNTIDALARASLLYAVQHLHSPLVVVLGHEKCGAVTAALQPPEALVEAPRDIKTLVKKIQSGIECALLEPGLEDVDDERLLCAIVCNVHSVARTLSEHPDIRPFIEQKALSVVGAYYAFNGVVSFFDDGEDGNATGKEVGSTVNGQASLCMSCSGTIHRSSSPTADPSQKVNSRLSVSEGLSKNT

SEQ ID NO: 8694 - protein, 84 aa, Nannochloropsis_gaditana
MSPLLGASSATSGVTRQTLTATVAPSATLALLPDFLTCFRGADYEQSQEIRMLRGGNLVLVDWYTSGRMGRGESWAFRRLSSNT

SEQ ID NO: 8695 - protein, 420 aa, Nannochloropsis_gaditana
METSNTSTSTLGAKALLRGTVAALAISSSLAFFAPSSHPLRSTAAAASRLTRQRAVAVEPPAAAPATKDAKPDWEADFRRKQASNELMHVYPDKVEVITSLEPMVEGMLSKLLLPTGEKAWQPQDFVPDLTKEGWEEEVKEFREKAATLPDETLVVLVGDMVTEEALPTYQTLLNTFEGVDDPTGTSPSAWCKWTRGWTSEENRHGDLLNRYLYLTGRVDMRAIECTIQHLISSGFNPKIKKDPYKGFVYTSFQERATKISHQNVARLANNAGDGNLGLICSKIAGDESRHEKAYQAIFKEILNRDPEGGLKSFYELMTDQITMPAVMMTDGHDPDLFEHFSITAQKLGVYTAVDYANILDHLVEIWDIEHIGGLSGEGARYQEKLCKLGPRYLKLAEMSLDRVKKMPKTPYSWIHGRMA

SEQ ID NO: 8696 - protein, 503 aa, Nannochloropsis_gaditana
MFFFSQTFLGMVQRLATVAALLLPFTSAFLLPSSPLPRVPSYRSASTRTLSMQYGSLREKPLKVIIAGGGIGGLVLANALQRHGIEYDLYEKTREYRPFGGPIQVQSNALAALEAINKDMTERIMAAGTTTGNRVNGLKDGVTNKWYCQFDTGAPAQKRGLPLTRVVDRPDLQSILLEYMDRSRLHTGVEVAEYTQLADGSVDVTLTNGERVQGDVLVGADGIWSNIRGQMHSESPGKESATYSGYTCFTGVCLARPHDVKEVAYKVYLASEKYFVCSDVGKGRMQWYAMLGQPSGKKVPDGVQGAHLIKEYQGWSREVLELLEITKEEDINQRDLYDRPPLLLKGWAKGPVAVLGDAAHPMMPNLGQGGCQAVEDGYRLAQELSKITDRGDVAWALRMYENQRLVRSSAVHGLARIASDVLFQSKLLFSNPVIGSFVGLMMTISMPLILEFLYQNVLDESDWGNAKGRLSNMAAYEDQSNTYKSVREAQQALASKERQLQPN

SEQ ID NO: 8697 - protein, 293 aa, Nannochloropsis_gaditana
MLARVCVLVATFFVMFSSSALAFVAPAVRMTARSAGALRMMAADAGEKANVAIVTGASRGIGKACALELAQHGVKVVVNYASSADSALAVVEEIKALGSEAVAIKADMSKPEEVEALFKETAAAFKDPVNILVNNAGITKDGLVMTMKPEAWQAVIDINLSGVFYASKAAASVMLRARRGRIINMASVVGQIGNPGQANYAAAKGGVLGLTKANAKEFAARGVTVNAVCPGFIESDMTEKLDLDGIKKAIPLGRLGRASEVAGMVRFLAVDPAAAYITGHSFDVDGGIAIGST

SEQ ID NO: 8698 - protein, 751 aa, Nannochloropsis_gaditana
TTIQAIGLRFLEGDVWAVRRVRHSQLRRQESLARLAMLGSLAALWRAHEQVSPASAHMSTSFALLDTPQVPMLGMVLIVSLTCLCLVYVRASKCAAWTTPDEPSTKTRLNEIKADPSSPSSRSLPSGGGEEGDVATSNADRLFLSGGVGMQRVPPRLSPAAGQSIIIIGAGTAGAAAAVGLAERGFKVLLFERDMSLQDRIVGELLQPGGVRALERLGLDECAKEGIDSVHVDGYVVFTPPQHKKEGGEKVQSILLKYPAYDPATLKELFGVIDPSPSSPAADRPTLSLSPPRFSEKEGDKLVHGAGRAVTPPFPEGTKVTPAPNPPSSPSGHLSMPPFPSFPSAAHQGPTSLHPQGRSFHNGRFVQRLRARALAEPNVTVVNGIVSRLLYAEPDSPTSRVIGVEYKIGTGRRVRNADGEEVEEKEVRRAMAPLTLVADGLWSSLRTHVDKAAKPTQLSSFVGLILSHPPMASPLPHPHCGHVVLAEPSPVLLYQISSTETRVLVDIFGRMPSASTGDLAHYLSTHIQPQLPPVLQAPFAAAVARGEFKSMPNRSMPAANVDRDGVLMVGDALNMRHPLTGGGMTVALRDVEALCYLLETSTDLGNPAAMRVLKGRFARERKAWAATINVLANALHAVFSTPAGNPTRKDLRDACFDYLSVGGYCAGGPINLLSGLTPRPSILALHFFLVAFHGVRKYLWPVPSWGGLGRTYEMLQVACEIIMPLLSVEKSTVLAAWPVRALVGLIFPYGR

SEQ ID NO: 8699 - protein, 424 aa, Nannochloropsis_gaditana
MSSTQTSQANKRLEHLGGHLVKKTSRPGFLGGDVVVVSALRTPLCKAKRGAFKSTTTDDLLAPVLEAVVKQSGVDAATLGDIVVGNVLQPGSGAVGARMAQFYAGIPYQVPLCTLNRQCSSGLQAFLQVAASIQSGLYEAGIAGGVESMSLTDMSTSVPDVNFERVSENALSKDCTIPMGQTSDEVATRFQVSREDQDRFAAASHAKAEAAVKAGKFAEEIVPVRVSSGGEDGGEDEVTVVREDEGIRPGTTPEKLGGLRSSFSEGGSTTAGNSSQMTDGAAAVLVMSRGAATAQGMHVMGVLRGAAVVGVPPDIMGIGPAVAIPAALAQARLRVEDVDVFEINEAFASQCLYCVRELKIPMEKVNPNGGAIALGHPLGATGARQIATLLHEMRRTRKRWGVVSMCIGTGMGAAAVFENEAAAN

SEQ ID NO: 8700 - protein, 278 aa, Nannochloropsis_gaditana
MTGPILSAFGAAARSAGRAFENAGKLLEVAPYVEHLAPSTKVLSFGGKAPAIHETAFVAPSASIIGNVQVGKGASVWYGATLRGDVQSITVGEQTTIGDRAVVHVAKLKGDAPTKIGNRVTVGPRAVIHACTLEDESTVGAGAQVLDKAVVKSHAALAPGAVLTPGKTVPSGHLWAGVPAKFVRELTAEEIANIKREAVASFELATVHKAETSKDYVQVEADEEAWIDKKQRSPNYWPRLKDPKDPAEIPGFGVPGRIFNHPLTVPLPEGSDRSGASK

SEQ ID NO: 8701 - protein, 267 aa, Nannochloropsis_gaditana
MSTAPAGKWEKEYDFILAEKKGKVALLTLNRPKALNALCNGIIQDLIDATTAIAADDTVGAIVLTGSTKAFAAGADIKEMKDKSFVQAFSSNMFAEWGHIARVTKPIVAAVNGYALGGGCELMMMADIVIAGENAKFGQPEITLGVIPGCGGTQRLVRAIGKSKAMELVLTGGMIDALQAERDGLVSKVVPAEKTVDVALEMATKIASFSLPVAAAAKETVNAAFELNLAEGLRFERRIFHSLFALQDQKEGMAAFVEKRKPTFTNT

SEQ ID NO: 8702 - protein, 107 aa, Nannochloropsis_gaditana
MVDNEPAPKRPCHGRASPVIEANPASQTAETAATAKSKVTVIGGGSFGLAMASVVGKKGHPTCILVRKDDVSNSMPPKKVSGEEGRKGPCCGKLGGMVHGDGIPKHM

SEQ ID NO: 8703 - protein, 514 aa, Nannochloropsis_gaditana
MTTTSIRRHRISTTSLLAMETNSTRDSLRTQQQDQPHHAGRRRRTSGSYAAWGLASAATAVMYFATVAHGFVTPLTSAPFRQAEAGNGLVGGSFAGKRSVCAGQSATSLGAGVLSKLDFKPAVDVYAKFPEPPKTAGTSTGTSTLSHEEVTLLTTAASQPSIVMSLDGPAPNDVDPFALVKKDLAPFSDSIKELVETENPVLTAAAKHFFEKRHGKRFRPTIAMLMSRAVQAGGAIDRDVGGAMATPMPVVDPLRYQRQSQLAQITEMIHVASLIHDDVLDEADTRRGDLAVHKLYSNKVAVLAGDYLLARASVLLARLENVQVVEIMANALDALVQGEIMQAKSSAKDLLDLGHYLRKSYYKTASLICNSCCSAALLGGYTYGSPTTVAAEKYGYHLGLAYQVIDDVLDFTGTADVLGKPAMADMTLGLATAPILYAAEEKKELKPLIKRRFKEQGDVEQTYKLVMGTEGVERAYQLAVFHAQRAVDAIASFPPSEAKDGLIKLAHMVLTRKS

SEQ ID NO: 8704 - protein, 337 aa, Nannochloropsis_gaditana
MSRYLLWPLYWYAQGSVLTGVWVIAHECGHQSFSPYERVNNLVGWVLHSALLVPYHSWRISHGKHHNNTGSCENDEVFAPPIKEDLMDEILLHSPLANLAQIIIMLTVGWMPGYLLMNATGPRKYKGKNNSHFDPNSALFSPKDRLDIIWSDIGFFLALAGVVWACTQYGFSTVGKYYLLPYMVVNYHLVLITYLQHTDVFIPHFRGAEWSWFRGALCTVDRSFGWLLDHTFHHISDTHVCHHIFSKMPFYHAQEASEHIKKALGPYYLKDDTPIWKALWRSYTLCKTAEEEEDDEWGVVPKPTEQLYLGNRKARELIGGAYADVNLAVKVAHDDTK

SEQ ID NO: 8705 - protein, 348 aa, Nannochloropsis_gaditana
MSWGTSLQIAATVDQAQVRPPPGEEGNWPRLSPFIRYALLAAEEALHHAQWHPRTSHDKERTGVYIGTGIGCLEEIVEAQRVMASGGGIRRVSPHFVPKILGNLATGNVSIRHGLQGPNHASITACASGAHAIGDAFRLVQYGDADVMVAGGTEACINALCLGGFSRLRALSTRYNDEPERASRPFDADRDGFVVGEGAAVLVLEEREHALARGVKPLAEIVGYGMAGDAHHITAPSPDGGGAFRAMRAALGSAKEVGGVRLWEVGHVNAHATSTPVGDVIEGQALQRLWEEHCRQDKRGAGRNARMDVSATKGATGHLLGAAGALESAFTVLALRDGVVPGTANLER

SEQ ID NO: 8706 - protein, 607 aa, Nannochloropsis_gaditana
MQAMWFSDFDRVSQGSFIEGDVAWFLNGKLNASVCCIDQHLPHRQDQVAILWEGDEPGHCRSITYKELYRDVCRLANAMKAMGVRRGDVVMLYLPMVPEVVMAMLACARIGAPHSVVFAGFSAEALRDRINDTNSKWVMTTDEGKRGGKTLPLKQIVDKALKEAPSVQHCFVFERTGAPVDWVPGRDVKMSEVMAQQRPYCPAETMDSEDLLFILYTSGSTGKPKGVAHTTAGYLLFAAMTHKTVFDLQEGDVYACVADCGWITGHSYIVYGPLVNGATTLLFESIPTYPNHCRYWDLIQRHRVTQFYTAPTAIRALMRYGTEDIASFDRSSLRVLGSVGEPINPEAWKWYFEHVGNARCTIVDTWWQTETGGHLASPLPGVTPMKPGSCTLPFYGVELALIDPSTGQELAGNDVEGVLCVKRPWPSMTRTVFGDHARYLTVYMQPYKGYYFTGDGARRDADGYYWITGRVDDVLNTSGHRIGTAEVESALVGHAAVSEAAVVGFPHAVKGEGICCFVTLREGVFESPALEKELKQAVRDAIGAFATPDIVCPTPSLPKTRSGKIMRRVLRKIASGESDSLGDVSTLADPSVVPYLITAIALKVKTA

SEQ ID NO: 8707 - protein, 842 aa, Nannochloropsis_gaditana
MGVFSASSSSSLSFASFPSSSSTARSLPTAVLLLTTLTALTSSVTAFHAPSTSITSSAHMTFPASSRTSSGGARSPLPIRARPRRTVFMETPLETGAGSSSTSNVPPPGTGPYQGPSSFPLLDSVRYPHDMKRFDLKDLKQLAHELRWDTLHHVSKTGGHLGSSLGVIELTVALHYVFNTPDDRIVWDVSHQVYPHKILTGRRDRMHSLRQTNGLSGFAKRSESEYDAFGAGHSSTSISAALGMSVGKLLTNKRVNNCVAVIGDGAITGGMAFEALNNAGYLRSRMVVILNDNGQVSLPTGTHSAGGVVPAGALSSYTSRLLSSKPFQDFRSFAKGLNRLMPSEIQDINAKLDEYARGLIQGGTLFEELGFYYIGPVDGHDLDNLVPILENLRDSPSTKPVLLHVKTEKGYGYPPAEVASDKYHGVAKFDVSTGRQFKGGNKGAPLSLTTTFANALCEIAAEDRTVVGITAAMPGGTGMDIFGKRFPKRTFDVGIAEQHAVTFAAGMAIEGLKPFCCIYSTFMQRGYDQVIHDVVIQKLPVRMILDRAGLVGNDGPTHHGSFDLSYLGALPDIVIMAPSDELELMNLLETAYETNDLPSVVRYPRGAGYGLETLKSELGYEGLEELPKRGKAVARGKGRIIRRSAVVPSTAAPGTCRVALLSVGTRLLDTVHAAKEIEENLPGVSVTVADARFVKPLDKEMVSSLAMEHDVLITVEENSVGGFGSFVQQFLLNEGLLDGGKLRLRSMVLPDRFIEAGPQSDQYDQAGLAARHIVEKVEGLVRGREERMLQQEQQQPQPHQQQQQQTGAGVGTVAEMVGVGAGKSSSSSSSSSRQGTSFQVLP

SEQ ID NO: 8708 - protein, 536 aa, Nannochloropsis_gaditana
MQTATSSSYSEQEGGDDDFSVKYTSLRDSPSLSQNHSSPPPATDNSMKDSCTVKGFSNGSKSSGLSPEMNSPAAGPNVSKPRRTYGSIMHAIIICWLVIAMSFGLNILNFLVYLTVRPWSRRTARRLIGNWFQSMWVSVMSYLMPPSELVLSGDVFPKTMDSTRPAIIIANHQVDADFWYCWEVARAHQLQGQLKIILKAELSQVPVVGWGMRQFEFCFLRRNWEQDRRGLTRLLSSFMEDGLNCALLLFPEGTTINTESLAKSHRFAQQQSRPRLKHLLLPRSTGFAACLETMCQSSTAPPPLIYDLTVAYGGYSGEVPSWAMGYGRDRDVGVPSVAEMVQGLIQPRVFVHVKTYQADHRLREDPQKWLDARWGEKDVRLGEFIKHQAFTTTEATEILRPTGSRLTLVFLLFLPLILTCLLPALILLTLVVWPLVLTAGTVHFLALLSRSALKAAVRSGGKATQGPGFGLGFPPPAAASPQQPFQGGRSFGDGEGGQGARGKRVGVHGSREPGPREAPRPKAQSERYLASSSARK

SEQ ID NO: 8709 - protein, 367 aa, Nannochloropsis_gaditana
  misc_feature (154)..(157): Xaa can be any naturally occurring amino acid
MITNHNLGNPEWANLPRKFNIAVSGSRDDYSHTHINDIGFQAVPHAASGIIGFNVVLGGYFSAKRVATSLELDLWVPPGQVLNLCYSVLRLFRDHGNRKDRQKARLLWLIEEWGVETFRRNLLAEMQSNTAYGAGAGETLPVDVAQAPSSSSGXXXXQAGRSWVGVHVPVGRFRAFDVHELGRLAARYSGGELRFTVEQNVIFPHVGDEDVASLLADPFLQTGRFRTDPGMDMERPQKSQGGPLARGLVACTGAQFCGVGLVETKNRALDLIERLEARYQLPHTVRLHFSGCPNSCGQSQVADIGLMGAPAKKDGKAVEGVDIFLGGAVGEGEGGRAGREGGREGENPWSEEKGHNSGGKTAPSLSY

SEQ ID NO: 8710 - protein, 596 aa, Nannochloropsis_gaditana
  misc_feature (267)..(269): Xaa can be any naturally occurring amino acid
  misc_feature (352)..(354): Xaa can be any naturally occurring amino acid
  misc_feature (430)..(433): Xaa can be any naturally occurring amino acid
MNGGKDATEDFEAIHSRTAWRMLDKYLVGVLSPSSPGTSSPPSLRTSGGAPASIPAAKVALQGKGKKLKCKLLEKEYAAPDVLRLKFALPHGNATLGLPVGMHLGLSAMVEGKRVMRQYTPVSKGDAKGHVELLVKVYRANQHPCFPAGGLLSQHLDRLAVGGSMAVEGPLGHMTYEGPGRLRHCGEDVQVEEFLAVAGGTGITPIVQTFSIGVGLPPLHFGVFFMPHTPWQPNAILKVRPPPSSHPLPPSFPAHSQVLRAILENPXXXADSTRLSLLYAARTPEDLLLFHEMNVWAERDDRFQVRPSLFSSLPPSLPLSLPPSCATTSMTFFPTTITIPSSLPPSSARSAXXXPPSLPPSQVHYTVDVPPSSWPYSSGFITAEMLRKHLPSPSPHLGVLICGPPPMVTRAVKPNLLELGACLGGGREGXXXXYISDRANAYAGIKGRIATQFALVLSESILIVWFSHSTSQTEATLLLLAFSVFVQAANGSCFAIVPYVTKQAGGSVSGLVGAGGNLGAIAFTLVFLSGQFASTAAGFRVMGWVVMAVSSTVWLLRPSFLDVDPLDLTLLTVSALEEGEGEAPTETDSVELTARA

SEQ ID NO: 8711 - protein, 707 aa, Nannochloropsis_gaditana
MHRYKHFAIRGIYGHWGHQGQGYQIMSSSLRVTQSRSASHVPSSSTIPSFTTLVEMQQSVARTQGKKDFLGYKPCPSSKYKWITYQAFNDMVGKAKFVLREAGIGPGDKVAALSGNRVEWAVGCMASLSLGATWVPMYEQQRLTECEYILRDSGAKLLLVGSREAYDKTRHFLTRPSRNPAFAQGDALSVINMQESKTVSSLKDIWTFDVDVPARMARVTGVMTAEADACFASAVVRPDDVAVLIYTSGTTGTPKGVELTHRNLCTNIEGMWEVVRPEDMPNALSLAFLPWAHSIGMNCELFNMMSRGARVALAQDMTTIASDIKEVRPNILFAVPTLYKKVYDRIQDKITSQGKWSRWLVDKAVAVAEKRLEILREGKRLSLGLQAQYEVLDHIVLSKLRDTLGGRVRISPVGGSKMSLPVTRFFEAALGIAILEGYGLSETSPLLSISRPDIQIRRLGSVGQAVKGAELAVVRDGLRVPEGEEGEIWASGPMVFKGYLKKKEETAAAFGEMDGKKWFRTGDLGTLEQGFLTITGRLKELYKLENGKYVCAPVVEKALLESEYIFQVVLYGADLPFNTALIVPNWEKLTAWCVSKKLPGLSASSRKTEIRTHPEVQAFMRENIVLACKDKMKKYEMPQKWLLLEEPFTVENEMLTPKMSIKRHAVIKAYGSALNAIYDQANVASYPKSRAKETPDTQQPYEDALAA

SEQ ID NO: 8712 - protein, 418 aa, Nannochloropsis_gaditana
MSSTSGSRFPLLPILVSCASALAHKQLSSFPEHGRVAVVALVFAFCFGLYAILSLLLNMTCESDPLSETQKLMAKFTCQESKQGIKVDSVIDGYNKLQDDAHTTQTDRNSNYSALVNAYYDLATLFYEWGWGQSFHFANQFRDENFRQSIRRHEYYLASRLDNLRTGARLLDCGCGVGGPMRNIARFTGLPVTGVTINKYQVGRGNELNAQAGLETLCRSVQGDFMQLPFPDASFDGVYAIEATCHAPDRTKVFAEIFRVLKPGQTFACYEWCLTDKFDKEDPSHRLIKKQIEEGDGLPDTAYTHEMDAALEAVGFDLIETRDMALEMTAEELRAGGRTWYHPLTPSYNVLSQRFQFTPVGMPLTTTLLKCLEFMRLAPTGTSKVQTMLQQGAIGLARGGEQGIFTPMYLCVAKKPLK

SEQ ID NO: 8713 - protein, 747 aa, Nannochloropsis_gaditana
MGLFVAPTTGHTAHSLSRRRRVGPALKPLYAATVAAPTASIPADAIAAAAEKKEKEANKKKRKATSMTPLEVHVIGLSHHNAAVEVREKLSIPEAQWNEAANKLCESGVIAEACTLSTCNRFEIYFAAHDSYAAFHEATAFLERHSGLPQSVLRKNLFLLSGEDAIWHLMRVSGGLDSLVVGEGQILSQVKQCYNHGMEEDGKGGKVISRMLNSAVAAGKRVRSETGISKGAVSISSAAVEFSQLRCPKDLGKPFEDSRVAIVGAGKMSRLLMIHMASQGVKAVTLMNRGRERAETLAAEFPEMEVAVRLMDDLWPVMHTHDVVYTSTSAQGCLLTKDNIQASGLAPGKVIVDISVPRNVETEVSEIEGMFAYNVDHLKEVVDRNTAMRKKQMLEAEDLLVEEMEKFRSWQFSLGAVPALMKLQEKAETMRMEELKKASKKLNNLSEKELQTVERLTKGIVNKLLHGPMSHLRATEDLEKNLVALKTLKAVFELVYIVDEGEGRMPTSPFFSVVQGFLNGTAEPYQWGILAGCLVYLTGVVVVLYLLVAGGSFERMREQAEAYKQLGVKALQVPLTSKPRLYEALLEASRSLPRRPHLDEGCLRGRGVELRLIETGDEVQATDEKGALARTLFGISDGSPRYGHGGYDPIEQIWRWLPESLGPPEGASEMRKFLDRTMRAREADSATFYVLDQPSGYVIGMASILENTPTHLRAEIGDIWLTPAFRGTYAGLEAGQLLLRFLFETLG

SEQ ID NO: 8714 - protein, 372 aa, Nannochloropsis_gaditana
MLGAILSSSERHAYHGFPAGGKTTCLFLSLWHPVGLRPMQHQHQAPPPRLATTADAHSTSRTSSPSAAASASSLPAFDLNKYLLDKKDAVESALDASLQVTSPQVAKITESMRYSLLAGGKRIRPIMCIAACEMAGGTAEDAMAAAVALEMIHTMSLIHDDLPSMDNDSLRRGKPTNHVIYGEDVAILAGDALLSTAFEHVAKHTPSHVPAERVVSVIARLAASVGATGLAGGQVMDLECEGKEGVGLEELTWIHTHKTAALLKVSVAAGAILGGASAEEVEACETYALDIGLAFQVADDILDVTASTEALGKTAGKDLNMDKTTYPKLLGLEGSREEARRLVGEAKAALGRFGGRAAPLLAIADYIVERKN

SEQ ID NO: 8715 - protein, 241 aa, Nannochloropsis_gaditana
MYNRQVIFVLSQLPRRQIFLLICLISSALAFVRPATVALHNQSPHLQGRDGIHDATAATSTPPRKGAPRMSAYSEPVPQATDPPFRIGHGFDIHRLEAGLPLVIGGVKIEFEKGSAAHSDGDALYHSVTDAILGAIGLPDIGQLFPDTDPKWKGADSAQFMREARRLMTLRGYRIGNVDVTLILQKPKVKDIKPQMKANLVELLGTEESRVNIKARTHEHVDSVGESRSWVVHVVILLEKV

SEQ ID NO: 8716 - protein, 292 aa, Nannochloropsis_gaditana
MRDSVALVLLWLLLVALIHSGISWSSSGTLLSKAFRPNSEHLPLSRPRRHLGFGPPTSVVMVQSLNLQGVLAIGQVIRNPSLMLPHVSVKHIGFLDFELLRQAGIKGVIFDKDNTITAPYVDEVHEQVAGAFETSKRVFGPRKLIIISNSAGTLDDSGHAAAIRIESSLGVPVLRHAVKKPGAIPEVLEHFKKECGPDTTYEDLCIIGDRLLTDVMWGNFAGMLTVHTQILTPEGDNKVAAIVRRLENGFSRILSPHWSAPSHPAMGKKVVVGSGGGEGKGGRGGGGSTDTQ

SEQ ID NO: 8717 - protein, 467 aa, Nannochloropsis_gaditana
MARLLLLSLLLIASAHAFHFHSSLCKTGASRMSSFRARQQRAESSSLMLATSRRSHTMTMMAAGSKPKKIVVLGGDGFCGWPTSLYLSEKGHDVIIVDNLSRRNIDNELGCSSLTPIESPETRVKAWEKVSGRTMRFVNLDVARDYQELVQLFLAEKPDAVVHFAEQRAAPYSQKGAKQKRYTVDNNVSGTNNLLVAVVESGLDIHVVHLGTMGVYGYGTSGGEIPEGYIDVILPGGRPSSILHPAYPGSVYHTTKCLDALLFQFYNKNDGIRVTDLHQGIVWGTNTPQTIKDERLINRFDYDGDYGTVLNRFIMQGALGVPLTVYGTGGQTRGFIHITDTARCIEIAVSNPPQAGEKVQIFNQIAETLRVGDLAKLVAEKTGVDINYLKNPRLESAENELEVANRKFRGLGLDPILLDSNLGLVDEVKTIAAKYADRCVREKILPASFWNRRREAECEANTLEGGK

SEQ ID NO: 8718 - protein, 521 aa, Nannochloropsis_gaditana
MCLVLAFVGVVVLLAAPARAFLPAPLSVSYSSLASAPCSPSAVTGRSRRPHMRAGPSEESGARRRPEERGLGPAPLEWWADPQATRRLLDPAAKERPVSGNQARSPGFWFKDVLSLQALKRRAFSLAVPVLLAVNGGSLFSGGMLHPPVAAAVDSIKVGTCLLKECQLELARCILDPKCLANVICLNTCNNKADEVGCQIGCGDLFENEVVGQFNACALSKKQCVPRKEDDGTYPVPPDSALVSSFDMNTFKGKWYISAGLNPLFDCFDCQVHFFTVQGDRLYGKLNWRITEPDGEFFTRDTVQRFVQDPRAPGKLYNHDNEYLHYQDDWYILDYEPNVFIAVYYRGQNDAWTGYGGGVVYTKQSSVPPEYKKRIAAAFAKANVDYARFKDVDNSCSDLKENPTALRAEFARRLFLTEEQQLQEALTTARVTAGNAIMMEEKEAQAAVKELERVISEFEGRVGKEVGREVENLEKELVKEVQQVERVIDTGLWRANNKPNLDSLAQRLEERPLADPRPAPK

SEQ ID NO: 8719 - protein, 914 aa, Nannochloropsis_gaditana
MHMASNEDHDTDAAKEVASAPHSPSHGADESTATTMAERPPGDNVDSYNEHGEQDGASAPSASTPPTPRSDAAEGGSSCPSTPRTDKREIKWCTEKQHTHADEEVEDGGEVDSLSDSSPTDATFSSSQRNRSQTFPLSPARPPQHASISSAASDGSAGRDFSDSGARTATSMKKRRLFFMFVLGVVSGAWALWRYQHIYPQYFNLPPSLNISSVLPAGLSIGGDVNSTILSDMYGVLSGASTPETYPGLEAAAKNYTAKYPIVLIPGFVTSGLEVWQGEDCASSLFRSRLWGALTMLQTMLMKPDCWTKHMALDMASGLDPPGIRVRAAQGLEAADFFMPGFWVWARLIRDFAAIGYDHSNLALQAYDWRLSLHDMERRDHYFTLLKWKIEGTVAINKEKVVLIAHSYGSNVILYFFAWVESSRGGNGGKNWVERHIATFVNIAGPLLGVVKSASAYVSGEMHDTAELGPLEGILFGQSKNAFHRKNRKRLFRTWGSLTAMLPKGGNVLWGNASHAPEDVEWEMEVGVVQGWEEGGKEGEGEKTCLPHLESETGTFRKDEASLHRAKEESGGMPAHRDHEEAPRAAGAKGGETCVTADEKRRQPVRHGHIFGFTPPVPLSAGSISASAMAVAAASAPPSASLACEGEEAVEDHVRRTAEANSSRDGTSARKPEGGSLQETAFANSSSTPASGADRTRHPPPPLQNWTMDEVIRYLQTDPEDAHLRRRMAEDYDFGPPVKDFKKQKHVKDDPKYWTNPLAVQLPQAPSMRVLCFYGVGKATERAYIYRADDNGKPDVMDISVNDARRNISGGVVMAEGDGTVTLMSLGFHCARLWRGKTHNPSKIGVTTRELWHTTGGLLSMRGDGGSADHVDVMGNTKMAADLLKVVSGQDQEEVFGDDIFYSRIREIAQNVEL

SEQ ID NO: 8720 - protein, 360 aa, Nannochloropsis_gaditana
VRRPRLQNFLARRLTRFRFFSHGGLLSSLSEQMASPSAYFPEKLSLLLKTLSGSDRLVNPHCIDNPFCAFNDWVNAFLFRDAVKADVMARLGPAGAHYFLTYVRDLVAGSVLYYLTAGLWHTYIYQWHGDYFFTQQGFEKPSAATIKDQIQLAQASMFLYAALPVLAEWLVESGWTQCYYYVEEIGGWPYYLAFTLLYLAMVEVGVYWMHRTLHENKVLYKYIHGLHHKYNKPSTLSPWASVAFNPIDGILQASPYVICLFLVPCHYLTHVAMVFFTAVWATNIHDAMDGNTEPVMGSKYHTVHHTHYHYNFGQFFIFADWMFGTLRIPEPRAAKAVLSPGVVPSSGVRTTGKSGRGKMD

SEQ ID NO: 8721 - protein, 827 aa, Nannochloropsis_gaditana
MMDRGKEETNPDWWEVLRNCQHRRLIIPPYCVQEVPELGTFSRLTTATTNAMKNMSGVIQRTSHLISGGSGKSAAAIKKGARQDLPSTQQEGDENMKGYTVDGNARGVKLRRRGSKQSIVGLSNHGTSAGGKPALQPTANPTPLTLSENGANPDASAASDARPKPHRLDLNGEEGNMVPCNGSLSSRAGDGKRVVGMSGLASTSAAAGSDASSANVKSMEISPADTPCRGRIRFLPHQRERQQIENHEKSHEGKPTRSGLPLRALDSQPPLTPYALPDAEGVLASSAQSSRHAPDAIAATPRLSSSHAANGEPITTPAQPVRLPSMEHAHSGTGVALSGGSSGVAGRGFIFSPLPEDCTPLLAFVNSRSGVSQGAYLIHQLRRLLNPIQVIDLANEDPARALRLYLELPRLRVLVCGGDGTAKWIMNVLEDLNPECWPPIAILPLGTGNDMARVLGWGGGYNNQSIVEFLAQVQRAHVVVVDRWEMKLTPAGKGSSRAKTVTFNNYFGIGVDAQAALKFHHLREQKPQLFFSRLVNKLWYGMLGAQDLFRRTCVSLPERLKIVADGKELTLPAHVQGVIFLNIESYGGGVKLWNVEEDDESAGNGLFDASSSSCSSEEGDRSEDESRRQRRRRRRRERQRRQQSQAEEEAHRQREQQEKPSSMALTSSSMQDGLMEVVAINGVVHLGQLQVGLSKAVKICQCREAVITTTRDLPMQVDGEPWPQAKSTIKITRKKDPAYLLRRTMDSGGAVVGEVVELLESAVKDGVISLPQKKSLLTELSRRVEMKRKVFEQELSQNDGVPSFSKGFDVSRLRLAADSNSKDCVLM

SEQ ID NO: 8722 - protein, 843 aa, Nannochloropsis_gaditana
MKAKQASKEALKPFIDELLALKDAYKEANGGVPYETPVAPNKKVDKEAKVQPERTGPSKKDLQKAAKKEKRAAAKAEAKKGGTHGNGGTVNAGVGRDILIPNPTRARPNMQEDTVFFSPGRPPLVTHATTLLTKSTVTFVPHAVASAPEGMLEPQLFLVDGTSLFGDLAIARFLARRSASPEHQALTGGSDVLLTSEIDQWLDFVQQYHMALAEEEAKGMCANLNAVLELRTFLVGFQLSLADAAVYTFLQTNRFMGHIAGLPHLSRWFDLITDSAPEIATASSRVAAVRGKAGAARGGGEEAGGLGGGDTGSCPPLEGAVEGQVVTRFPPEPSGFLHIGHAKAVLLNDFYARHYKGKLIIRFDDTNPSKEKDEYEESIVADLASLGVVGDRVTHTSDYFEDFEKMARKLVEDGHAYMDNTPQEKMQEERLNRQESVNRNNSVVDNLARFEAMLKGEKEYCMRVKIDMTSVNGTMRDPVLYRANPQPHHRTGTKFKAYPTYDFACPVVDSLEGVTHALRTTEYNDRDEQYYFLQDLLGLRRVKIQSFSRMNFVQTELSKRKLTWFVEQGLVEGWNDPRFPTIQGVLRRGVSVEALRAFILSQGASRRTVLMEWDSFWSINKKGYEHSSPRYMAVFADSCVPLQVENGPESRQDAGAAISIPLHPKRPELGSRVLRLANVVLLEGQDAEGLTEGEEVTLLRWGNVKILSVEKDPATGRVLRVRGRYNAAGDPRATKLKLSWLADVRDKVPVVLTEFDYLISKKKLEEGEDFKDFINPVTKAESLGWADPALRNLKRGEVVQLERRGFYICDRPYMGPEKGVVLFMVPDGRSKAMSTLSGALKHV

SEQ ID NO: 8723 - protein, 338 aa, Nannochloropsis_gaditana
MRSLSAGIKSLLGSDHPVLEACAKYFFELDGGKKIRPTMVLLISRAVAAHAPAQGVNGSRAFTSTSESSTPLPSQKRLAEITEMIHTASLFHDDVIDEADERRGVPSINKIYGNKMAILAGDFLLARASVSLARLRNIEVVELLSTVIEHLVKGEVMQSRPQALVDGSGTGENGQAALEYYLHKNFYKTGSLMANSCRAAVLLAGGGDALQNQAFAYGRHVGLAFQLVDDVLDFEQTSETLGKPALNDLRQGLATAPVLLAARTFPDEVGDMVKRKFASEGDVERALDLVQRSDGLKKAKDLALVQAEQAMGAALTMYPSPARDGLIKLASLVVNRTS

SEQ ID NO: 8724 - protein, 394 aa, Nannochloropsis_gaditana
MSGKSMAIGLAAGLLLSAALLYPRVRSKTRTSKTEPDTDLSYPSSLPPDEKEAFIEICDQLTVELLTELKSRYELPAEASEWVKKMIEYNVKGGKLNRGLTVVSVKRTIDAAKGRVLSTREFARAAVLGWCIEWLQAFFLVADDVMDDSVTRRGQPCWFRLPQVKLIAVNDSFILESNVFQILKRHFGHEPFYVTLFDLFREVTLQTELGQLLDLTSQPMDGQIDLQRFTPQRYQLIVKYKTAFYTFYLPIACGLILSGMGHSAALTTARRVCVLMGEYFQVQDDYLDCYGDPKLIGKVGTDIQDNKCSWLVVQALAKATPAQRTVLEAHYGKHEDSSVAAVKTLYREMGLEVLFKQYEEQSYTAIQKELDALPADIPRPVFELLLKKIYRRSK

SEQ ID NO: 8725 - protein, 476 aa, Nannochloropsis_gaditana
MSPPSVPAIPRTLATRVIGRRYVASKISAGAGIKSSSKGNGMSSSSAGSPAGNSHHKNNKHPNHHAHSPHSHTAAASPAALQPPKSLMTASSLGSQQASVDTSRSKNTITRAVASTASAGGYVPNSIAPPQPQVSPPAPQAPLTSDAIPPDVLWGESGRMASSGSVGGVELPVDEEHRAALLAEAYAECQRITSIYAKTFYMGTSFLDYAKRSATWAIYVWCRRTDDIVDSPRAIVENTMDADLEQWSKRLDDVWEDRPWDSLDATLCDVRTRYPGMSIEPYRDMIKGMVMDVPGLGQHRYATFEELYLYCYRVAGTVGLMTLPIMGTAPGYSLKQATEPALALGIALQLTNILRDVGEDAMRGRIYLPLEDLARFSVTEDQIMNKIMNSNYRELIKFQIARARVYFDRAEEGIPMLSPDARLPVRSSLDMYREILNRIEDNDYDNFRHRAYVSKFEKLLILPLSWMKTLDWGRRR

SEQ ID NO: 8726 - protein, 473 aa, Nannochloropsis_gaditana
MLSWRADDSDLPQSVTIKSTIAKLEESLQAKDTSKLQFILLNGLLKRNHLGIDERDLHIRALSGSKLLVERYDKKVVECIKYITECQELTREEKVMFVKKARRALGQTALMLSGGGSISMYHAGPGPFTNTVADLQMVCRGDAPNVTLLALHESKHTPSSKVRVKNIRISSFPSSPGTGVVRALITEGLYRHIRVISGASGGSIIAGMAAIHNEKELMDRVLVKEVSTDFKHNGEMRQKKIVWFPPLFEQAKHFIKNGILIDNKEFQRTCEFYYGSFTFQEAFERTHKHVCISVAASTLGASSQGGPRRLLLNHITTPNVLIRSAVAASCALPGIMAPNYLQCKDDRGHVVPFDMDGVQYVDGSLQADLPFRRISTLFAVSHFIVSQVNFHVVPFLRKMHSPAESSLYWKLFRFFDTDIRHRVTSLAELGLLPRVFGQDLSGIFRQRYSGHVTLTPRFRMSEMIGLKAFQVKS

SEQ ID NO: 8727 - protein, 751 aa, Nannochloropsis_gaditana
MVNENPLILKRHLEDEEGAMLLQKERATSSVRPEAMATFIFGGQEALSRRLRALAFIEKDPVFDTKDRKHLDQKSRYVRSSEKAVHLVLKCRRLGIPFTQMLDILNVALDEITPTDVHTKMAIPSLMHQTTPEQRAKWLPLAENFRIICAYAQTELGHGSNVRALETIATYEPSSQSFILHSPRLESAKWWPGGLGKSATHAIVLARLLLGGKDKGLHSFIVQLRDLRDHTPLPGVTLGDIGPKLGFMSVDNGFCLFDHVRIPREHMLMGLAEISPDGHYRKRKGANGGEKILYGAMLDVRAGLVERGGATLARALTVAIRYSAVRRQGYAPSPPGKLSQSAPLELQVLDYPTQQHALMPLLAWSFALQITGQFMRRRYKAYLRELDLSLLPEVHALSSGLKALTGEVVSQGVDVCRRMCGGHGYLLASGLPEVFSNYTAVQTFEGTAQVLEPQLARFILRLSMAPTERPKASGRGAATAAKAPFALSSDFDYVPLAAGKTFVRCRAATPVAFLDPAFQIEAYEARVSALLLLAREEVEADLRGGEGGLAASMMKNGVLFGRLSRAHCQLVLLRRFHEAVAREEGRMTMTTARNGGVDGEGNGGRIDLGAADGSEEGESEDREETVTVGPAEVRVLRNLCHLFALSGMERDMAEFRARDYLSSGQAEMVSREVLRLNRTVRAEAVSLVDAWLLSDKLLGSALGRADGRVYGALFEEALRSPLNDKEVSEAYTLHWRRLLMAGDCAWENARL

SEQ ID NO: 8728 - protein, 441 aa, Nannochloropsis_gaditana
MIPLLPIALGGVLAAPFMGTLYRRATESLHIAQTAYEHRIAGGLQPTTPLINLFVVENQEQLLVWMNLGYLVLTCGLYAHMRRREKAHQLKQVLTVYNLINVVVSSYVSASILKYKLFSSVLNAPLPQHANSHSPPFIATSFICNQLPLGHPGLASVFAVYYLQKYFEFLDTYFFILRRSFRQVTFLHLFHHTSITVIVGSLMPFDFGGDMYFPILVNSLCHVAVYLHYFCTCLGLNPWWSAHLATLQVAQFAAIFLQSLLAFYEGPRCGSPDFSKILMMVYTGSMLVLFSDFFFKRYILRQPAYDMCGVMKNDPAEAGLSTLSYVGSVRLGPDGSAVVCLPRHFREGLSSPLYVYHLTPVGSPMPNLYVSREVLWGSGISDGEINRKRGDRTSSEGVVLMEQVVQRAGGSYTFVVRGGRPKGLVSWTVCCVVGDEAIRQH

SEQ ID NO: 8729 - protein, 208 aa, Nannochloropsis_gaditana
MQGYYKDPSSTRKAVGDDGWLNTGDLGYLNPGTGDLVLTGRAKDLIVLSNGENVEPQPIEDAVVERCATVEQCLVLGHDKRQLSALVVVSPQGLAARGLLPPVEAERLDALVGPSAVLLGCQGDKTALDMEADRLNADESLVRAVQKEIAAALTQDPEEFRAWEQIKNVHLLLAPFNVQSGLLTQTLKVKRVTVQDYYKEAIDRLYAQ

SEQ ID NO: 8730 - protein, 364 aa, Nannochloropsis_gaditana
MPCIRKIVGIFALLPIMAGAFFLPGVSPQRNTALRMAAEAGGAKPVRIGTRGSPLALAQAYETKRRLGEAFPELAPEGMVEIKIIKTTGDMILDKALSEIGGKGLFTKELDVALLGDEVDICVHSMKDVPTWLPDGTVLPCNLPREDSRDVFICNKAKSIAELPAGSVIGSASLRRQAQILARNPNVKVVNFRGNVQTRLRKLSEGVVDATMLAVAGLNRMNMQDCVTSILDWDEMLPAVAQGAIGIQCRSDDATSLKYLAALNHPETKVCVDCERSFLAELDGNCKTPIAGQARVIEDKLHFKGLVAMPDGTQMFETEKVGALADAVKIGREAGEDLKEQAGPEFFKALYAALPAPTPKPAVA

SEQ ID NO: 8731 - protein, 445 aa, Nannochloropsis_gaditana
MWQNKNGKSSGLLPGRESLGPLFLMGTTPIFIFITWFTMQHLDGDFGRLIESFRAHGWGYLKIIVPSPFDPTAWKVILSYMAVELAFMRLLPGKTFKATVTPAGNVPVYRANGMQAYAASLLLFFLLQRYGPAHGLHVSWVYHHMGELLSAMNVFSLAFCLFLLVKGLTFPSSSDSGSSGNWVIDFYWGTELYPRVLGFDLKMFTNCRFGMMFWALGILCYAQAQAEKDGFLSNAMLVSVLLQLIYITKFFYWETGYLCSMDIQHDRAGYYICWGCLVWVPAVYTSPSYFLVNHGGRDIGSLTALLLLSAGAACVGINYWADRQRQVFRASDGKCSIWGKPPVFITASYTTEKGEKRSSILLASGWWGVARHFHYVPEIMGAFLWSCPAGFYGLRFFLAYFYVIFLTPLLFDRAFRDDARCRDKYGKHWDKYCALVPYKMIPGIL

SEQ ID NO: 8732 - protein, 303 aa, Nannochloropsis_gaditana
MLARAVLPTRSGSLAAAFLKTSSATIMPPKQLQGLSRTLQVKSYRQSTVFYRAMSTTLKPEERAGTFTPAAPSTTTQEKEELRDGARSIIHFKLSPNRHALNVPKLDPKEKVWENPTHHSVWTKEEVENVEVTHLPPADWTSRVAYTIAQTLRFSFDVLAGFKFRKATEDMYLNRMVFLETVAVFFLSYLINPKICHRLVGHIEEEAVRTYTHIIEEMDAGQLPLFNHVIPPPIAVSYWKLAPDATFRDLLLAIRKDEATHREVNHTFANLKENDDNPFLAEEEYRAKITTMGQPTPVAEKKA

SEQ ID NO: 8733 - protein, 382 aa, Nannochloropsis_gaditana
MSLSSANRPTACLALADGSVFYGRGFGATGTVSAELCFNTAMTGYQEIMTDPSYAGQVVTFTFPHIGNVGVNPEDDETADPVADGMVVKWDPTEPSNWRAAETLDAWLARRGRVAIGGVDTRRLTRAIRQQGAPHVALCHDPDGNFDIEKLVAAARGFAGLEGMDLASKVTCAQSYRWDEMRWAWPEGYTRQTEARHKVVAIDYGAKRNILRCLASAGCEVTVMPASATAEDVLAQNPDGVFLSNGPGDPAATGAYAVPMIRGVLERDLPVFGICLGHQMLALALGGKTIKMNHGHHGANHPVKDLDTGKVEITSMNHGFAVDSQTLPKGVVQTHVSLFDGSNCGIRIADKPVFSVQHHPEASPGPQDSFYLFERFAASMDR

SEQ ID NO: 8734 - protein, 817 aa, Nannochloropsis_gaditana
MPDPAFFQCLGVTRATLTPSLLVNLLHCNAPILSRGQLRFCLCSGETLSFITARTLLMRAPLCTIIHLYGSTEVSGDASWTTLTTGDLEYGKTANLDIVPLGKPLPGTRMWLVGSETSTKLEVGQIGMPVDMNGELWVEGPGVALGYYGKQGIHSNFVAKERDGHPVFKTGDLVRCISDTTNTSLYFLHRRDSSAKVRGVWIHLEEGERELALALGLNSKEELGLSVVSSNTDTENSELLIALTWKAAQSWPNLPKLRQRLIGRGISPELMPTRIVIGMKDQLLPLTSNGKLDRQMLSTWGSEVASRCTSYAEMVRSRFKDDSSGYWLEFCFSKLVGTQDENHIGLGLFQRGGHSLLAMQALYHIERHFKAASAGVMIEDMARPVAEISKKIGKNRDTLPRKRGRSFTAETISDRNQLPTMLQAWTFEFEKCVDAQPCVVSLDNGERLIIVGSHDHYIAALEANTGKVKWRSYTSGRIEGKVAVQNDLIFVPCLDYRLYAFSLVTGELAWTFITQGELKCTPLPLWLPSPTHDESKGISLVLFGSYDGRIYVVEASSGACFAKPFPLQGSPYASPIVIPGEKRNSDSDERIITVTNRGRVAQLKLEREGMVLKGAHLRWALHSDWEQEIGCAVFTTPVYSTTTAYLVFGGTDGAVVALDPFHGGSIVWRILLDQVQSSPIFISPCLMPRNSETEIELVLIACQTSLYCIQTSSGKHCWKRKLETRPDEVITGQPTFLEGSLIVLLTTQFGKLLLLNLDSELDAVDTGTRELILTGESRLTSPAIITLPKETVFPYRKSWQCSIGSRDNKVYMINISG

SEQ ID NO: 8735 - protein, 536 aa, Nannochloropsis_gaditana
MSLCHLHIAGKNIRPDKAKKMGLADVVVDPAALETVAVETARALAEGSLKGKRKGKGLLQKVLEDTSMGRSIVYGQTEKMVAKNTGGHYPAPTAILDTIKYGFTHSKPQALEYEATRFAELAATSVSAALRGIFTGTTALKQSKYGKPANPVETVAVDKDLAGVSRGEKYISDNLKGKMKKKRMTKYAYDTTTSRVVGLTDESANWGKQFGKADMVIEAVFEDLSLKHKVIQQLEEHLPPHAVFASNTSAIPIARIAEASQRPENVIGMHYFSPVPQMPLLEIIPHKGTSKEAAAAAFEVGKKQGKTVIFVKDVPGFYVNRCLGPYLVETGALMEAGVPLEQLDKAIKAYGFPVGPITLADEVGVDVAAHVQAFLSKADLGVRMGGSDGPILDALLKAKLLGRKAGKGFYTYPAGGKKEKGPKTLNPEATSLVQKYVKGESKLTDEEVQNRLVSRFVNEAVFALQDGVIASPVEGDIGAVFGIGFPPFLGGPFRLIDALGAGKYCSMLEGFAGKYGEQFAPAPLLVEHAKSGKKFH

SEQ ID NO: 8736 - protein, 383 aa, Nannochloropsis_gaditana
MQEPKHAYRGTPLLISLLMFSMLGLSLAKGPKSVSPPGLPGFLHFPSSASSSLGALRSPGPSASLSKCPSIVEHRKGVVSAAGKDEDSQERKPQGLKMKNNGGSTSKGRLHELPIFKSMAANQDGELQRDNSDSSEQAKVSAASSYVPGGRVPAVVAEANKAIVSSIKDALVAVYGDRHYARFHALETIARVPYFAYTSVLHLYETLGWRRRADLMKIHFAESWNELHHLLIMEELGGNAEWLDRLVAVHLAFFYYWMAIALYMASPETAYNLNEMVERHAYDTYDKFLETHEEELKALPPPQIAKEYYQTGDLYMFDEFHTNSPAERRRPKIESLYDVFVNIRNDEREHFMTMAVMQGHSGDAGIVSPNTLDPLNNPRRGKD

SEQ ID NO: 8737 - protein, 459 aa, Nannochloropsis_gaditana
MATKKLWGGRFSGKVDPIMEKFNNSLVFDRRMWAVDLAGSMAYAKAICLAGIISEAERDELLSGLLKVKAEWAADTFVVKDGDEDIHTANERRLTEIIGPTGGKLHTGRSRNDQVATDVRLYLREETRRLRSLLVELLHTMTSLAREHLPLLMAGFTHLQPAQPIRFSHWVMSHAAALLRDLQRLVDQEQRINVLPLGSGALAGHAFGIDREFLRQELGFAGVSLNSLDAVCDRDFIAEFLSWAALTTVHLSQVAEDLIIYNYTKQVGLSDAYSTGSSLMPQKKNPDALELLRGKAGRALGAATGFLATLKGLPRSYNKDLQEDKEPLFDTIDTMVAVLQITTGVFATLTPNKEALAAQLVPEMLATDLAEYLVRKGVPFRETHHISGAAVKLAEERGVPLSSLTAGDLQALHPCFGEDVAEEVWSYEKSVERKNAPGGTAMASVRAQIDAVESYVTAL

SEQ ID NO: 8738 - protein, 811 aa, Nannochloropsis_gaditana
MVEEIQIEGTFPDGTKLVTVHEPICRLDGELQLALYGSFLPIPSLDLFTPPSSAYMEGGEGKEEAEQEEEEALGHFLTPPGATWNVNEGRKITALRVTNMADRPIQVGSHYHFIETNPYLCFDRARAYGKRLNILAGTAVRFEPGETKTVALVEIAGKKVVRGGNSLCDGPVEAGKVAGIVEGLMKKGFLHEPQDEGEEGAEGGKEDEGEGRKRRKTNVLAPLTVCRAHYSHFYGPSVGDVVRLGDTALYVRVERDLTWPVGDECKFGGGKVIREGMGQATLETETCLETVLTNALVVDYTGIYKADVGLRGHRIVGIGKAGNPDMMANVTPGMVIGVGTDVIAAEGMILTAGGMDAHVHFICPQQADDALASGVTTFVGGGTGPSTGTKATTCTPAPAHVAFMLQSTDSIPLNIGLTGKGNTSRPEGLEAVVEAGAIGLKLHEDWGTTPAAIDCCLGVAERMDVQVTIHTDTLNEAGCVEHSIAAFKGRTIHTYHSEGAGGGHAPDIISVCGEPNVLPSSTNPTKPYTKNTVDEHVDMLMVCHHLDSCIPEDVAFADSRIRGETIAAEDILHDLGAISIISSDSQAMGRVGEVITRTWQTAHKMRLQRGQLQEDQEREEEWTRQEEGNGWALPPGVTTENFRVRRYVAKYTINPAIAHGMSHVIGSVEVGKWADLVLWSPAFFGAKPEMVLKGGVVAWSQMGDANGSIPTPEPVIMRPMYGATPGGLGEACLAFVSQKSVETGRASALGLRKRVEAVRGNRMVGKRDMKLNDALPKIKVDPETFRVTADGVHLTCEPLEVLPLAQRYYLF

SEQ ID NO: 8739 - protein, 236 aa, Nannochloropsis_gaditana
MSRLIRKGLDTLGKALRETGQALDRTGMEALGSDKHKELWSRHRQVSNLFDQRPRVASNAFVSPSATVVGEVSLWDKVSIWYGAVIRGDRNSVKIGNCTNVQDHAVICTVPSLDSGFPATVDIGNLVTIGHSATITSATIEDKALVGIGSIVSEGALVETGAQLAAGSVVPPGGRIPAGELWGGNPVKFIRKLEDEEVLANVAAAEAYHALAQSHENEFLPFGAAYLDAEKVKVSK

SEQ ID NO: 8740 - protein, 507 aa, Nannochloropsis_gaditana
MDVTKDNSVQAARRTILKDLASRGPEPDNPLPFVGLVNNAGVTGMAPLEHHALPEVEKIFAVNVFGLLRSPINLIKSSYQTYGSVFTVNLFTQRMTFLIGPEAAAAFFKASDKELGQDEVYGFMKAVFGEGVVYDSDPKKRNLQMQRTANALKSGRLRTYVEKISEETEAFFKGWGEAGEVDICEALSDLIILTASRCLHGDDVRQELFAEVSKLYNDLDQGITPVSVLFPNLPIPSHWKRDAARKEMVKLFSKVIQRRRAAGAAEAEARTDILQVFMDIEYKDGSKITDDEVTGLLIALLFAGQHTSSITSSWTALYLAQNKGLQDRVYAEQVAIRGQDTGSEAALRALDFDAVGKMDLLFNCLREALRMHPPLIMLMRQCRQDLLVQSQEGKAYTVPKGSVVAVSPSVHQRLPSLFPAPDSFDPDRFAPPREEHKPLFAYVPFGGGLHACLGQQFAYVQLKTVLSLLFSKFELTLATPDGAVPPPNYHAMVVGPTAPCTVKYRRR

SEQ ID NO: 8741 - protein, 578 aa, Nannochloropsis_gaditana
MQRNGRSLLYPALLTLGGVCLASIVALPLGVKARVAKGKVKSKRGMDPFTRFWMEWMTEYRGVVMVMVVLPLSFAFEQYFEVRDWFYRTFQVAPRLHDARVRHVQKQVRRWNAAGLRGKRTMCTARASWLTMSTRTATFKEDCSKIECCLRDILRVDVEKGFVRTEPLVDMRYMTRTLVPLGYQLAIQVEMESLTIGGLCMGLGMETNSHRFGLLQETVLAFEIVTSHGELLRVTRESNPDLFYALPWSHGTLGFLVAVELKIIPIKPYVHVRYLPCHTQEELCSQMKALSEAKNPPEFLEATVYSKETSVIQVGEFADVDSPEKRRKVNGVNHFWKPWYYLHVEEALTNKGPFDEYIPVRHYHHRFTRSIFWELRDLIPFGNHPLYRCLLGWLGAPKVSFIKLTMTPQIRREVVYKHVVQDIIIPVDEMAHSINLFHEWFEIYPLLIFPIAIFDHGPAHEGFLRNPTKKIPGKNCQMFFDLGVYGVPDKVRRKEAWDAKARIRAMEKYTRDVGGYQCLYADTFMDEKEFRLMFNHALYDKMREKYDCEGAFPSIYQKIRPEAGVLEDEGDANEKTAV

SEQ ID NO: 8742 - protein, 803 aa, Nannochloropsis_gaditana
MPRFKLSSIFSPSRKMTQEDFMRKDECLVVDDRDLLLRTENKYNCHRFTPEQPRGLLHRAFSVFLFDKTGRLLLQQRAASKITFPQVWTNTCCSHPLSGFTPTEVDMPEDLANGKVKGVKRAAIRKLQHELGIPSFQVPLRKFKFLTRLHYWAADAATHGPAAEWGEHEIDYVLFIQVPTVTLRPNPEEVNAVKFVSLPELQEMMHPSSGLRWSPWFRIIAERFLPLWWADLKLTLRTNTYFDPTTIHRFEPPTDPTGNISPSEFAQDTAASAPSGGLVPMGRASASPTLPPAFGKGDEGKKQGAYGKIKSHSESLVSQLLRVDEVGAALRLKFARPFPETDVGHAGDADVRFCADMLGRVSRSFAAVIRQLPKGLCLETVVFYLVLRALDTVEDDMEAFQKDPGAKLRHLRGFYHVALEDPEFKMHGVGKGDEARLLENFDRVVRVFQGLTPGMRTVIKDITRRMGAGMADFVDKDLGQGTISLQEYDLYCHYVAGLVGEGLTRMFAESGLEAPDLATSRQELANSMGLFLQKTNIIRDYLEDFVDGRAFWPQEVWKRHAPSAVPAQSLGAFAEAEHRERALACLDELVTNALEHVPDCLAYMSRLHTPQIFRFCAIPQVMAIATLEKVYHNPDVFTGVVKIRKGLACKLIMEANSMGDLYTCFSSFAGKIARRAAALEKRGDSVSAQTLRVCEEIRVLCKEGEASSTNTKKYARALHAAFAALLLAIALVPVLALWGTESSRGGFFARPIESPAGLSGADYVQMAFNVLVSVVATLALSYVVSKVWRPLGGQGNRSRSLAA

SEQ ID NO: 8743 - protein, 803 aa, Nannochloropsis_gaditana; identical to SEQ ID NO: 8742

SEQ ID NO: 8744 - protein, 642 aa, Nannochloropsis_gaditana
AHGYPRREAAPLKKSNLGQWHALLRGASSTSIVLRGDFIGRRTKMIPCRQSLGLPVAVALLSCVFLSVRAFHLPSPAIRTRISSSTSISASHGRPRSLPSLYASSTSSPPAFGQFLTDLLGDLFAGPEKVEETDVLVVGSGISGSTTAFYLNKAGVKCLLTEAKPVVGGNVISKSESGFLWEEGPNSFQPTYPLMQATVDMGLADELVLADASLPRFVYWKEKLYALPGGLGDIPFFNLLSIPGRIRAGLGALGFIRGPPKDKEESVKEFVTRHLGAETFERIIDPFVSGVYAGDPSKLSMKAALKKVKRLEELGGRGILDGALLRIQEIQRTKPPVVPEHPVYKGGQLGSFKRGLQSMPLAAAKALGKEKVRLSHKLLSVVEGKGPKGGYEAVFQTPQGRKRIKCQALAITAPAHVVHKLLRPLVPEAARLADVYYPPVASVTLAYPKTAFREPLRGFGNLIPRSMKIRTLGTIWSSSLFPGGPPDYNMLLSYIGGAQDPGIAELSSQQIVKEVDRDIKKVLLKPDAPAPKILGVRLWPTAIPQYNKGHLDILASVEAGVKKHPGLFLGGNYRTGVAFGDCVTYGMEEAGRIQSYLAAKAPAPQTSVPPSPPSALAPGPCPLPRLRLPLLPQTRPIPRLLP

SEQ ID NO: 8745 - protein, 442 aa, Nannochloropsis_gaditana
MSISPRPQGGSLLLAVSVLFLSNGLQAALAFSPILRSAVGHDKIQSFVVQESRWSTLSPLFAGSIDGSKIVNPDHDILLRVARGEQTHRTPVWLMRQAGRYMAAFREYSEKYPFRQRSETPSMAIELSMQPLEAFGVDGVIMFSDILTPLPALGIEFDVISGKGPVIPNRIATAMDVDNVRRLDDPASSLPFVGETLRTLKNEVAGRATLLGFVGAPFTLAAYTIEGGSSKNCLKTKRMMMYDPTLLHVYLDKLATAIGDYACYQIENGAEVIQVFESWAHQLSPSQFLKYSKPYADKVTTIVKERHPEVPIIFFGHGASSFLELQGDMAADMICLDWQVDMATARRTLGAKPVSGNVDPTVLLGPPEGIVAAVDECVRKAGGGGHILNLGHGVIKTTPEDAVRLFVDTAKSIELKAASRESGSDGPPPSSLVRPALAGAGA

SEQ ID NO: 8746 - protein, 475 aa, Nannochloropsis_gaditana
MALGDGGIKPNVSTFGADQFDSRSAEGKRAMESFFNIFYAAINCGALISFTLVVSITQYGVSWIGGMDYRFSVGFSVAAIITTCGIAIFLFGRHRYTKLPPSGSVLARSLSILLQAARKGYGHWRGSRRSAFSESHRGDISNGDHANIGTVPLLPSAPPPFSSQLGSPALPWLDRAKRSNGGSFAAADVEGVKCVWRLLPFLLFLIPYWTCYTQMSTSFQNQGCQMDLSLKPFFPATKIAVSTLNLFDTLGIILLVPLFDRVVYPFFERRGQPLTQLQRFGAGFVFAALAMGTAGVLELYRKSQSPVETKYPTDADDMTTVHFLEEHISACKNIDDYNPLAYQSWFAAGAAASGRPPPSACAKVGPTYSNGTLPLSSIECDFVPLISHVSVFWQIPQFILVGISEILTSITSYAFFYAQAPPNMRSFSASLNLLTTALGTWLCIPLVALANSGKVQWVPSDVNKGNLAAFFFMLA

SEQ ID NO: 8747 - protein, 458 aa, Nannochloropsis_gaditana
MRLSTLSVLGPALGCAFLLFDSSLAYLPSYMRGSKGQIYMKEKSQRVVVTGLGPISAVGIGKDAFWKALLEGKSGIDRISGFDPSGLTCQIGAEVKDFDAKPYFKDRKSAVRNDRVTLMGVAASRIAVDDAKLDLSSVEGERFGVVVGSAFGGLQTLETQIQTMNEKGPGSVSPFAVPSLLSNLISGVIALENGAKGPNYVVNSACAASTHALGLAYAHIAHGEADVCLAGGSEAAVTPFGFAGFCSMKAMATKYNDNPSQGSRPFDKDRCGFVMGEGAGMVVLESLEHAQKRGAHIYAEVAGFGQACDAHHITTPHPEGAGLAQAITLALEDAGMAKEDLTYINAHGTSTAYNDKFETLAVKKALGEEVAKKMYLSSTKGSTGHTLGAAGGLEAIATVLAIETKTLPPTINYETPDPDCDLNVVPNKPITLNEITGAASQSAGFGGHDSVVVFKPFK

SEQ ID NO: 8748 - protein, 788 aa, Nannochloropsis_gaditana
MEAFHRRGMKTALALARSKSAIPSSMVAPQQRQFFAAAYNLAKKVTPKISATEAAALEAGTVGFDRDLFAGSPSLEGLKKKYDLKISAEERAFLENEVEKLCEMSNEYEMYKNKFRSHVGPPGLLSCTAPSFQDLPQPVWDYIRKNGFLGMIIDKKYGGKGFSAHGHALVVQKLSTRSQSVGVSVMVPNSLGPGELLKRYGTEAEKDYYLPKLATGELIPCFGLTGPASGSDAAAMRDQAIVVEENGQLGVRATFKKRYITLAPVAGCVGLAVQLKDPNGLLKGKGKEGISIFLLERDLPGLRMGPRHDPLSAFFMNGTVEGENVFIPIDKLLGGQERAGYGWNMLMDCLAEGRAISLPAGAIAIGKLSVTAVGAYARIRKQFKVPIAELEGVQEHLARIAGHTYVITAAQSLTNSMLNQHEQPAVISAIMKQQCTSRGRQIVNDAMDVLGGAGICMGPNNFMGANYMATPIAITVEGANTLTRSLIQFGQGLMRAHPHLLSVVQAVQKGDDLQGFNKGLAGMFSHGAVNATRSFSKAFIRSRSKSNFEGYYESQLGRLAAAFAIASDLSLTMGGKIKFAESLSGRYADVLSNLYLGYATLWFHSKYPAQGSEAVAAWALDNILVDIQDAFYGIAENYPIRPVGWAIHALTFPTGKTYVRPSDKLTTQVAQLISKPSGVRDLLSQDIYVHKDLNDRVALLNATLPKAVKVDEIYTKLRKEKRTATAEEQKLIDEVEAAREIIIQVDSFPSLGQESVTKGWKTEDRPALQDIYGVKKGKNGNAAEQLAA

SEQ ID NO: 8749 - protein, 119 aa, Nannochloropsis_gaditana
WCDSYFFLPGRQEHRGTGGIFFDDLEALEGGGEEAGEEAGEEGVERARMFTEAVARSFMPSYLPLLYDRGVKFGLAGGRFESVMVSAPPMAAWKYNHTPEEGSEEARLLAILKTPRDWV

SEQ ID NO: 8750 - protein, 700 aa, Nannochloropsis_gaditana
MEVAPELVQERGKASFPPSTLTQLVDGGVAKMARRRWLRSLILSDPIFNNEDSIYLNHTERYKRALSKCGRLDQLINKYRLNEEDSIVLRSCTSEDLPTLLHDLMFLPCLLSLCSEEQQAYWVPAARSKKVLGCYAQTELGHGSNIQALQTTATFDPATDEFIMDTPTAQAYKWWPGTLGRTANTAMVIARLLLPQESSSSSPASYKDMGIHNFIVPLRDLHTHALLPGVVTRDIGPKIAFAGMDNGCLELHAVRIPRANLAQRFVRVTRQGVWSRVEGTHSKAAYVTMMQVRAIIVVHSARELSKACTIAIRYSAVRRQGFDDSKTGSELQILDYASQQYRLLPLLAASIGFFFCGRAVLTLLAETEDALLKGRKGQAEVGALMGRAHAALAGLKSLCTTIAADGIEECRKCCGGHGYLACSGLPELSGNFLQQCTVEGDNVLLTQQTVGYLLKSYIKWRTGGPVLDEECQYFVTAADGAHAEGLGEGGNGVRDEPAVLSLFSRRAFATLERLALRLQSLTEGEASLSQAGAWRRVLVDVMFVSRSHALYTVLRHFAAGLKSLRDGNDVSGVGKAGADAAFIRVLERLFFLFAFYHLSKEAGDFLELGLLSPETVARVRGEVEILLGEVRPDAVALCDGWDWDDFELKSALGRWDGRYAEALLASAKKEPLNHQDPVDGWDRTWQPQWKVEEQTERARL

SEQ ID NO: 8751 - protein, 417 aa, Nannochloropsis_gaditana
MAGKPKCVLAYSGGLDTSVILVWLIEKGFDVICYCANVGQLKEDFDKVREKALKCGASKVYIEDLREEFVKDYVFWAVKANAQYEGRYLLGTSLARPVIAKRQVEIAQKEGAKWLSHGATGKGNDQVRFELCAQALDAAIQTLAPWRETEFIERFKGRQDLLDYAAAHNIQVEATKKASYSVDENLYHTSYESGMLEDPMVPPLKEMFKMTVDPEDAPDKAEKVRIDFEEGVPVKVTNHDDGTVKTEPLELFLYLNELAGKHGVGRIDIVENRFVGIKSRGVYETPGGQILRVAHMDLEGLCVDREVLRLKEGHQLEFSRLCYNGFWFAPEMELTKASIDFTQRRVAGGVELSLYKGNVTVLGRESPYSLYSADLASMEIEGGGAAFDYVPMDAQGFIRINAVRLRAYNALERTFNK

SEQ ID NO: 8752 - protein, 406 aa, Nannochloropsis_gaditana
MSASSFAARKGLFIVGAKRTPFGAFGGKLKNFSATELAYLASKAALCQAKLDPSAVNVVYAGNVIQSSNDACYLARHMGLKAGVPQHVPALTINRLCGSGFETVIMGCEAMELGQASVALAAGTENMSAAPFVVDGNSVRWGVPLGKGPEMKDSLWAGLTDSLAGTPMGITAENLGAKYGITRQECDEFGLRSQHLWAKAQERGALQAEIVPVEVKTKKGIDLVTVDEHPRPQVELAKMSKLNPVFKKDGLVTAANASGIADGAGALVLATEDTVHAHKLEPLARVVAWSRVGCDPSIMGIGPVEAIRGALSVSGVALADLDRIEINEAFAAQFLACAKELGLDMSKTNVHGGAIALGHPLAASGSRIVAHLANGLKGQQGGKKGYVMGSACIGGGQGIAVLLQAV

SEQ ID NO: 8753 - protein, 404 aa, Nannochloropsis_gaditana
MTHSFSVGGGGAGGGGGAGAMNRAHSSAVAGRSLVKSKEKVGAVEARELTAGKEGGGVATARALAAPEVQDMTRRVSTHCGRPLFFLTRTPSINCLTCNVDLGMNLFLRIIRRREDGYHELASLFQTVAFGDTLLLKVLPAIAVQDEFSSSYTSLVTDQSNLVLRALDLFREKTGKTQRFEVYLEKRTPVQAGLGGGSSNAATTLFAANQLLGTPATDEELIEWSKELGSDITFFLSKGTAYCTGRGELLEPVPPLPSSIKLYVVKPPVGLSTPAVFKALDLDALNGEDPRDLLAAFTQHLSRGELGPASMYINDLEPPAFQCVPRLKAIKEALLARGFDCVMMSGSGTAIFAMAPAPSSLPSSAGLSFDAAAFAREMEVDIWATTFTNRPSDDPKAWYPNPHA

SEQ ID NO: 8754 - protein, 101 aa, Nannochloropsis_gaditana
MVISFIFSWMLQILACIFICPFLPSCKERLLLLGWIFRSVSSLVIRLNPYWHLRVLGPRPTRPPSKTLIMCNHLSNADAFFLSSALLPWETKYIAKASLFQ

SEQ ID NO: 8755 - protein, 245 aa, Nannochloropsis_gaditana
MRTTIMAATKPKVTSVGTDDKTEVREYFNTEGFQRWNRIYSEDGTVNKVQADIRVGHQQTVDKILGWLQADGVKGESICDAGCGVGSLAIPMAELGAKVAASDISSSMANEGRQRAEAVLGKATARARCSFSTSDLEALKGKYDTVTCVDVMIHYPTDKMQGMVSKLGSLAKKRMIISFAPKTWYYDILKKIGELFPGPSKTTRAYLHTEEDVRKALKAAGFTVRRTEMTATNFYFSRLLEAVRE

SEQ ID NO: 8756 - protein, 688 aa, Nannochloropsis_gaditana
MPSRSTIEVIKGDNNQNNLAYCLVVVILLAVDANPIKVIATSIGIPARWFAYPCLAMLVHLFLTHSQEFLYDGVRVFFRSILSIFFRQIDIVGIDNIPKHGPIIFSGNHSNQFVDGLMVLTTAQHRVGFLIAEKSYKHPVVGTFAKLAGAVPVTRPQDSARPMQGTIVIRGRHVEGQGTVFLRDLVPGDKVRIKGQADQYKVETVASDESLTLSEDGPLPPAQATAASAFEKLAKVDQSRVYNAVFEHLKQGRCIGIFPEGGSHDRTDLLPLKMGIALIALGMVDKYNITVPIVPVGLNYFRGHRFRGRVVVEFGPPIRVPEDLIELYRSNRREAYQRLMAEVEDGMRATLVTAPDYHALHLVYTARRLFQKDNWIPSPGEKMDLNRRFAEGYKILMSKYGDERPAALNELERRLNDYQKTLHRLGLRDYQVPTLREDDSLRLCYTIAHLFLVFTLAMLPSLVLNAPVGVIARFVSSREQKKALAASRVKIEARDVIMSKKITLSIVLVPTLWIVYAVLLLRFTSLPPSTVAVLFFSCPIFSYLGVMATEAGILDAKDLKPVLLRLLPGARKKMATLPAERTLLQHDLRAYIHEIGPELGSLYTDKTVKWEEYIRKSSSATDLQSLLPSGSPNGKDGRAETEDTRGERNGHASSLSFTSPALAQAVNGRGTPSPLTFKPDEQFNKKDA

SEQ ID NO: 8757 - protein, 472 aa, Nannochloropsis_gaditana
MKSAFFVSSLLVGAQAFNPTLPLNNAFVQRQAARAEPIRAVRTRGDVDMKYRVVVVGGGPSGSCAAEELAKDKNIETVLLERKMDNAKPCGGAIPLCMVSEFDLPAEIIDRKVRKMKMISPTNREVDIGQTLKPNEYIGMTRREVLDGFLRQRAVNTGATAINGLVTKVELPTTEGGRYKIHYSNFEKGTGAAGVPETIEADVIIGADGANSRVAKAIDAGEYNYAIAFQERIKISEEKMNFYEELAEMYVGDDVSPDFYAWVFPKYDHVGVGTGTVINRPAIKMYQKAIRDRAGDKIANGKIIKVEAHPIPEHPRPRRVVGRVALIGDAAGYVTKCSGEGIYFAAKSGRMAAQSIRELMAGGTRLPTEKEIKDTYIKDYDRLYGPTYTVLDILQRVFYSSNAAREAFVELCESEYVQKVTFDSYLYKRVQGNNPVEDIKLLFKTIGALMRGNALAPRDKPVYNPVESLKRL

SEQ ID NO: 8758 - protein, 643 aa, Nannochloropsis_gaditana
MAGSLVVADRLRSGPGRKSRAKDSHRHLPPTSRSANCEASGGKRELSPVEQLEDMRTTPIKCRDGTLVYPYSLPTRDAQLNRLKKEKFDVLVIGGGCVGSGVALDAQIRGLKTAMVEANDFSAGTSGRSTKLIHGGIRYLETAFWKLDYGSFALVQEALEERAHMLNAAPYMNSPLPIMIPIYKWWEVPYFWAGAKAYDLVASRQKSVPSSHYMDVDEALFQFPMLRGKGLKGAIIYYDGQMNDTRMGLTIALTAAQEGAAIANRVEVVSLLKDPGTGQVNGARVQDRLTGVEWDIAAKVVVNATGVFADKIRKFDDPKAVELIEPAAGVHVMFPAHFSPAKMGLIVPKTTDGRVLFFLPWEGCTLAGTTDSHSDITMHPQPTAQEVNFIMQETNRYLTTNVAAKDLIAAWSGLRPLVKDPEKIKEGTAALSRNHVIEVSETGKLITITGGKWTTYRRMAEDTVDRILQEHAGLLANGDVSPQASTWNRKLLGADRAGIVCAQKFNQIGITLRNDYELPEDVSAHLVKSYGTRALQVAEWVRAGYLDTKPGKAKRLHSRYPFLEAEVIFAVDQEYALKPMDILARRTRLAFLDTEAARAAVPRVVKLMGDLLGWSWRQRTMEKAEALAFLETMNVEKTALLKK

SEQ ID NO: 8759 - protein, 437 aa, Nannochloropsis_gaditana
MAPLKKYMQPAMVLAAATAGMTSAFLLPAMRPVPAPTTVTCAARTSPLFSRSSMPSVTPARPTKGTILSATNFFESFFAPKSASGAGARGGKKTIVLTGTSSGLGKATLKALCARGDNFVICGVRDMEKMQAVAEELGLDPSSYTIRPLDLSSFASVRRFAKEVKAVKGGKPLDALVCNAAVYLPARDYPTFTPDGIEESLQINHLSHFLLVSLLLDDLKKAKDPRCVIVGSITGNDNTIAGAFVWPRASLGDLKGMQEGAKEPVSMIDGKNFNGAKAYKDSKMCNMMTVNELHKRYHDATGITFSSMYPGCIAETALFREKRQWFRTLFPLFMKYVTGGYVSENEAGERLAQTVWDPALKTSGQYWCWNGQAQQFGYYDPATKQVRGAGGSGGTVFPGKLAGQVMDQAKAEKMWELSSEITGATWPSVGVRELANV

SEQ ID NO: 8760 - protein, 586 aa, Nannochloropsis_gaditana
MTLTVTGLISCCSGRALASITCAAGRRQNIAGFLGRARISTFRSPTSTKQPLQQIDQPKSSPDALFARRMSTLMAAVRVRFAPSPTGTLHVGGARTALYNYLVARQHKDGVFVLRIEDTDTARSTRESEESMLADLRFLGLDWDEGPDKPGAVGPYRQSERIDVYKKVAQQLLESGDAYPCFCTEEELEAKRQAAEAAGKPPQYDRTWRDADPALVKEKIEAGEPYTVRFKVAPGRRVEIDDAVRGTVGWDADATVGDFILLRSSGMPVYNFCVAVDDALMGITTVIRAEEHLTNTLRQCLILEALKYPAPKYAHCSLILGEDRSKLSKRHGATSVDQFRAQGFLPDAMLNYLALLGWNDGTEQEVFSRQELIDRFSLNRVVKSPSVFDMAKLRWVNGQHLRALPDENLVPLVGACLEEEGMVKVGAEGAAFVSYATQVAKGSMELVNDAATIVGDVLTYPLEETLASGEADALVAEGLWEMAREVVSAFEANEMPRGKEEDFAALWKAWVKAVGKKMGRKGKQLFHPIRLALTGRMSGPDVGEQIRMLHLAETGATSVVDLPTRIEKLREILRKAPVEAKEPVAG

SEQ ID NO: 8761 - protein, 590 aa, Nannochloropsis_gaditana
MAKLGVAVASISALLGCFSVQAFIPQTPLSELARHGRSRQSSTSRLVPSANFLVDYPPPGERRDYPRPNLEETSSSFKIAEQLSEEIKKFPRPKEGKPTVVIAGAGLAGLSTAKYLCDAGFKPIVLEARDVLGGKVSAWQDKDGDWIETGLHIFFGAYPNMMRLFKELKIEERLQWKSHSMIFAMPGKQDAEGRQRFSRFDFPSFLPAPFNGILAILLNDEMLTWPEKIKFGIGLLPAIIQGQDYVEKQDSLSVKQWMKQQGVPDRVNDEVFIAMAKALAFIDPDQLSMTIVLTALNRFLQEKDGSKMAFLDGPPPTRLCEPMVEYIRQNGGEVHLNAPVREMMLHREFRESVVDGFRLPNGTIVQGDLYVSAMPVDLVKKVIPKRMKERWSYFDQLDELEGVPVINIHLWFDRKLTTVDHLLFSRSPLLSVYADMSTTCKGYQDDEKSMLELVFAPAKDWIGKSDEDIVAATMEELYRLFPTELSADGSKAKLVKSAVVKTPRSVYTPLPGKEAFRPDQRTPVGNFYLAGDYTKQIYLGSMEGATLSGKLCALKIAQDEQEWDGRSQAMDLIAEEEKRAGRAAEAAIKV

SEQ ID NO: 8762 - protein, 210 aa, Nannochloropsis_gaditana
MDQESLKTMMAKVSERFGGKLDVVLHAVAQASPPAMQNAFTETTAEAFAQAHLVSAHSLVTLAREALPLLAHRHSHTAGTQGASTRGTRNSSILTLSYLGAQRAMPPYKVMGPAKASLEASVRLLAAELGPPPHQIRVNALSVGPVATLSARGIPGFNDMCRAAAASAPLRRNADLEDVGGAAVFLASDAAKSVTGQVIFVDGGLSIMAP

SEQ ID NO: 8763 - protein, 397 aa, Nannochloropsis_gaditana
  misc_feature (187)..(190): Xaa can be any naturally occurring amino acid
AAVASLLLLLSSGSTDAFTSAARPRVSTSGYIHQPIANVGGSRRLDAVAMARSAPCYRRRVAMAASAPTKEAGPSIGWDSHKAVDSVPESLVRGVEGNESMRRRFEKACREAQIAICKAVEDCDGGAKFHSDAWVRADGGGGISMVLKDGKVWEKAGCNLSVVYGSMPQEALQAATERGVDRAKGLXXXXKEGGREGGRGGGKEGGKGERVPFFACGLSSVMHPRNPHCPTMHFNYRYFETEGGAWWFGGGMDITPSYLNTEDMTHFHGTLKRVCDKHDAAYYPKFKKWADEYFLIKHRGETRGLGGIFFDDQNDKSPDQHFAFSEELLQTVTEAYLPIIEKHKDDAYTEEEKKWQQIRRGRYTEFNLVYDRGTVFGLKTGGRIESILMSLPETARW

SEQ ID NO: 8764 - protein, 596 aa, Nannochloropsis_gaditana
MEKEPDGFAQERRCLATLRSFHVIQMPCNVMTTSLVPLFPLLFALTHLSPGVAFVPATPSPFPCILSSTPHPLTIPTPRPATSTAVSAFLNDDSRFGPSSLTPSPGPSPPQGRITLVGAGPGDPDLLTLAAIRAMATADLVVADRLIPPEMLKLVTGNLKIAGKRPGCADAAQKEIYQWVRDGMAARQHVVRLKIGDPFLFGRGGEEVLEFREKLGVDPEIIPGVSSAFAAPLLAAIPVTHRGVSNQVYVCTGFGKGGDRPYLAPFYVNQTAVFLMAVGRLRELTRQLTSVAGYPEETPVAIVEQASTPRQRTVVATLDKIAAVAERVRVTAPAVVVVGEVVRVLLEEGEDGEEGGRVIEGKAGGKGCGDAMLAYIGGAMTDQEAALFGADGRGGGKEEGGIPSFFKRLRRARDETAGRSEEVEEGAKEAIMARRGGGRRRTSRLRKWKFWYGRTNVTDSMLSRNRPGPAPPPSPPVRASSSPLASEPHPAPNRLRIPFHSSNDGQSFIRLDDAASVAEAGGEEESWSIFDHPVSSISSVSATGTPPAIHEILGRRVNFDALSADASLYSMLRAWVQDDPTRQVPWVAMSLDRPGN

SEQ ID NO: 8765 - protein, 402 aa, Nannochloropsis_gaditana
MATLHISNLTLSIYNHGIFVLMSAALSFLLIVWRFSLAEAGRSHHFEGPSSNPVKPHSITIVGSGNFGSAIARLLGRNVLRSPKHFRSEVRMWVFEEELDDGRKLSDVINADHENVKYLPGIQLPTNVRAVPDLSDAVRNASIVVFVLPHQFLPGLLPRISSCLHRGAMAVSLVKGLDFDDEGPVLITDMIREGLGEDVSEVCVLMGANVADEMARDEFCEATLGCPDPEGAGAVLQQLFDCPTFRVEVTPDPIGVELCGALKNVVALAAGFCDGLDWGGNTKAAIIRRGLEEMRLFCKLLHPSVRDMTFFESCGVADLITTCYGGRNRKCAETFARAGGTMAWDEIEKEELGGQHLQGPQTTSKLHKVLEQKKWLSRFPLFRSVYQIAYQGRPPATLVQDL

SEQ ID NO: 8766 - protein, 258 aa, Nannochloropsis_gaditana
MVGTMVDKPTGRREAGKVNAIGKFWKPWFFKHVESFLAKGSSEMKGKDVEAVGEEYIPLRHYYHRHSKSLFWEIQDIIPFGNHPLFRYLFGWMMPPRISLLKLTQTEALRKLYEEHHVVQDMLVPVKDLGESLDCFEEVFSVYPLWLCPMRIPKNPDFRKHGGFIRPLEDGDEMFVDVGAYGNPSMEGFNAREACRKAEDFVRAKKGYQMMYADSFMSREEFREMFDHGKYDELRRKMDRCLQAFPEVYDKVSKAARV

SEQ ID NO: 8767 - protein, 477 aa, Nannochloropsis_gaditana
MSPRSMPVLLVAVLAVLCTASVTAFHTPSSPSAPSIWGAKRGAASAAALTTRRQAAADGEAVENVLSPKQERRRIIQSPNFHRQGFKAESEGVESQMVSEFTSQLINEMKDSTYTFQKGDLTIKLAKSFGFCWGVERAVAMAYEARAHFPEQRIHITNEIIHNPGVNERLADMNIDFLPVDEGKKQFEHIEKDDVVILPAFGATIQEMQLLDKKGVQIVDTTCPWVAKVWTAVEKHRKLESTSVIHGKWNHEETIATASFADVYIIVKDIHEAEYVCNYIVNGGDKAEFMEKFKNAVSEGFDPDVDLEKVGLANQTTMYKRETRAIGKLFEKTMMHKYGPAEVKNHYAEFDTICDATQERQDAITDLMEEKLDFILIVGGFDSSNTAHLKEIPHMQHIPSFHIDRAERISADGSIEHREIDGSIVKTANFLPDGPLTIGVTSGASTPDAYLQEAIERLFLLRTLKGQEAPQKDTVNA

SEQ ID NO: 8768 - protein, 409 aa, Nannochloropsis_gaditana
MSTSLSAPPPTRESGHVGSRPNSTSQEKKEGSKRRYAKEVSDSLWADALAYLLAIVILLNFWSAAFLELVMYVVFYPLCPSIWYVTRILGVRFGWLFPMLCLKWSNVRIRMTGKGAAATSLGAIPPSPFSFSSSWQRYRDLLTPGKLPRALIMINHLSWADTFVLSPWLHAHNSVNGDTCWPMWKGFMQMPLGWIAYMSECPVLGYGKEVDLKTIHRSVTRFFERRMTKFFLFPEGAVFREEMRSKSHQYATANKLPLLDHCLLPKHGAFYRAGKELHRQGMTTLVDLTLAYPPASSLYDAPFNVLDLVKRHAKPLYLPLHVRTFAMSEVPWDEEGKVQDWLNQRFMEKDKMLEEYYQNNGGALVEGAVEEGSRWQDLLMDLCVWIVLQAVMYGALLYLGRRMLGYGPV

SEQ ID NO: 8769 - protein, 179 aa, Nannochloropsis_gaditana
MSRAAFKALKVAPEGGLIINISATLHYGATWYQTHASAAKAAVDSLTRSLGLEWGSFGIRVVGIAPGPIADTPGMAKLAPTDDSSAVDELVAEMIPLGRMGTKTDIALAAVFLCSSAGGFITGETLVVDGGHWLFKPQMLPRELVSDMSRRVESKSRAMTPSSGLSANAETISRPSSRL

SEQ ID NO: 8770 - protein, 247 aa, Nannochloropsis_gaditana
MERKMDRWELRMTEAVPSLDRHRQPVKYMLGYLGIGVDGKVALDFHKLRDRAPYLFLSPTLNKFYYALMGLRDFFVRSCKNLPDKVELWCDGKPIVLPPQTESFIVLNINSHAGGVELWPEYLMGGGMEGAFKPSRFDDGYLEVVAISGVLHLGRIRVGLDRPLRLAQAKEVRIRTKSFLPGQVDGEPWRLPRCELTLRHNGQAPVLQHVSKELLQYNEWLVGQGKLDAAGKDQLLQAFKRRLQVSQ

SEQ ID NO: 8771 - protein, 497 aa, Nannochloropsis_gaditana
MHGRSKKLGNILEELGVKKGDRVATLAMNTYRHMELYFAVSGAGAVLHTLNPRLFAETLTWIVHHAQDSVLFFDPCFASLVERLLPHCPSVKHWICLVDEERMPVLPSLSPSSPFLSLHNYEALLREGKEDYVWPILEETAASSLCYTSGTTGIPYTAAMVGCKLVLPGSALDGASLYELMKEEGVTLAAGVPTVWLPVLHHLDQDPGQGLPKLRRLVIGGAACPPSMLRAFKERHGIEGKHLALPTEDQHNVLSTQGRTIYGVDLRIVAPSPPPYLPSSSSSYSPPYPPRWSEVPWDGVSPGELCARGHWVATDYFSPTQAPEEGERDGGVRAGHQESFYTDDDGERWFLTGDVATICPDGYIKITDRSKDVIKSGGEWISSIELENIATNHPEVALAAVIAMPHRKWDERPLLIVVLKDSAALSLHYSTTSSSPSTSSDTDRAIRLTKEALLDHFKGKVAKWWVPDDVIFVDSLPQGPTGKILKTELRQRFSRRP

SEQ ID NO: 8772 - protein, 345 aa, Nannochloropsis_gaditana
MALDVKEKNLIKFIAKRLIPILLIFCSFASYMELWAQPVRLLGFCLVAIWIIKITRRVILFLRVKLFPRDPLSYGKWAIVTGATAGIGEAFAYELAACGMNVIIISRSLNKLEEVKKGILKESPAAEIRCMAYDYTDREGAEAFFMKLSETCKHLEGGLGILVNNVGMVNAIPEYVHLLDDPTTYGILQVNVEGTVRTTRAIAPLLIDQRKGAIINVSSGSGNHPTPMISCYASTKSFITQFSQCLSHELREFGVDVLVVTPYYVISNQFRRKKATYIAPTAQRMVQDTLPILGYCDVAFPYWFHALCGFFVGLYWDVGGSVMAAMRRNRARILEAAAKKEGKKE

SEQ ID NO: 8773 - protein, 434 aa, Nannochloropsis_gaditana
MATFLRFPRRFITSPSITKFIAGTKRNRVPYVCIPTLSSIQSSHLATLPDIAAPTLGLDETQCEYFNLAHSFAKNELTPDNAAKWDSKEIFPVETMRKAAQLGFGAVFVREDVGGSGMSRLEGSVIFEALAAGCTSTAAYMTIHSMCGWMLDSFGTEAQRQRWLPRMATMDLLSSYCLTEPNSGSDAVSLSTKAVREGDSYVLNGSKAFISGAGVSDVYLVMCRTGEKGPRGISCILVEKGTEGLSFGAPEKKLGWKSQPTATVTFTDCRVPASNLIGVEGEGFKYAMKGLDGGRINIATCSVGAAQACVEKTRAYIMERRQFGKAIGENQYVQFKFAEMVTSVVGARLMVRQAARLLDAKDSQATVACAMAKKVATDSAFTVINDALQMHGGYGYLKDYHVERYLRDVRVHQILEGTNEIMQIIIARKLLQQD

SEQ ID NO: 8774 - protein, 645 aa, Nannochloropsis_gaditana
MPDRATFLVLFFLGTTALKLLLQPSYRSTDFEVHRNWLAITYSLPIHKWYFNNTSEWTLDYPPFFAYFQWVLAQTGAALNWDPEMLRISAAPYASDPTVLFQRLSVAVTDVLLLVGILVWVQTIPAETGSPSRIGTLAMMTLASAGLLMVDHMHFQYNGMLLGILFLSMAALRKGWILAGAGLFASLLMFKHLFLSLAPVYFVYLLSSYCYIHPPPPGQEIKSRFRPVTFLLLASTVLAVFAAALGPLLLSPSSTPSLQLDQLGRRLFPFGRGLVHAYWAPNIWALYCLDDLGLAALSRRLHLPFLDRSRPSSAPTWTSGLVQVIEPEVLPPVSPALAAVLTLLSMVPALVLVWKRPTPRSFLLGLFQTGLSAFMLGYHVHEKAVLVPVMVGALLACSYNRSSYGRLFFWLSTIGYASLLPLFPPLSPDSLTAFLLIHLHALGSWFGLGKEGLLGGEGGREGAFSLLESLYLAGLECMLWTVAVIHPLFAQDRFPFGGCLVIQVFDSWAGHLSPADYDIFAAPYQRQVIEKIKAKHPTVPIIIYINKSGALLERMAQSGADMVSLDWTVTMEEGRRRLGSEMGVQGNLDPAILYAPKEVIKERAEQILREGKGFKHVMNLGHGIEATTPEENAKFFVDTVKAWRY

SEQ ID NO: 8775 - protein, 3854 aa, Nannochloropsis_gaditana
MSTLPSNGNGSTAPAEGRWTKGRGWDGIGPWCDDATAEEICRAADKLSAEDKTLTVAKAIRFLLPFCGDKRALTYLDGKGAEIEVQTFSDVMDCAMRIAAYLQREMGLKPGDRAVLLYPPGQEFILAFLGCIVAGVVAVPVYPPHPYRMETDLPRLNLIVKNSGCKVALTDSQYMLVIRGIAVKNMLSRVGLAKGATWPSLRNVQTDKIRRSYAHTELLIEPDPQPDDLAFLQYTSGSTSLPKGVMVTHSNLIAQIRLISLRSVEIFGYTNQLNVVSWLPQYHDMGLIGIFLTCLSTGTHLIYMTPISFLQDPTMWLYTLHRYRAAITCAPNFAFALAQRKTSEALRDSMDLSCIQCVICGAEPIRVEVMTSFFAFFAKSGFNPYALMPAYGLAEFTLCATSQPSGKPLNVLYVNQQVLGATGKIELVPTETPGAACYVGVGGPYSKDGTQCRIVNPDTGECQGQGRIGEIWLDGPSKTRGYFDDEEKTKAAFRGMIKGEEHLGHVYLQTGDQGFLWKDELFITGRIKDLIIVRGRNLYPQDIEYAVEAALESTLRPGCSGSFSLDCNGEETVAYVAELRSHTTDHELLQSTVDQIRRHIAEEFQVAVSVVVLVEPRSIPKTTSGKIQRHKCKMGYREGTLKACFIWEASDGANGLAVPPPPKLGVLALSLNDDDDMSDDSFVSATLGGAELGDDFSSPETNYQRSPFKRKVSASFNSPYSSLSGMAPIKLPPVGEVPAATGSPAEDHGKVTRNGQDETVQVVGGESWEVPSPVAVPPGSYVGNGEAEEEGGISKEHQAFIDKMIDYVSKAREMQRESIDIDQPMSLLGFDSAGFVAMGRVMGDWVGKEISPAIVYKYTTIREIAGFLSRGADDSELSSGDLDEAIEADLDAAIAIVGIGLKAPGGPTGNLVGKEAFWKFMMAGADAVREDMPIERKTEEGLMLPGGYMDNVDAFDANFFGMSPAEAAHLDYHQGHALEVTWHALEDAGIEPSSLSGRTVGVYIGAISHEFAVLESLRGESSTWAATGISNSLVANRVSYLLNVRGPSLTLDTACSSSLVTVNDAVRDLRMGVVGIALAGGVNLILSSSASTALKKAGFLSTACRTFDATGDGYCRGEGCGMVVLKRLSRAIADGDRVYSVIRGVAVNHDGKTTSLTAPNPLAQEAVLRAAYRDAHIRPSQVRYIEAHGTGTKLGDSIEMAALGAVMQSDRDREDGSKFRCIVASGKSNIGHLEAAAGIMGLIRCALVLYNGQVPKAVHFEQPNPLIPWERLPFIIPRANMPLQEEGVADDPGATVVAGVSGFGFGGTNAHAVLESVPKNFDFDDSFDTAVTASSTAKQPLPLLLPVSARSKEALTKLVGQYIDLLMGSGKNGSGKVMSYDRAVQVCLEASTRRTHHHGFRVGATGRSAEELVASLKDSLDEGDIVPVSQTAQSPEVVFLFTGQGAGYKGMGRQLYERNAVFRASMDEVDALLTPHLEFSVLKTVILTKDDYAVGGLTTLQSQPTLFAIEYSMARVWAMLGVQPNVVMGHSVGEIVASVFAGIISLPDAAKLICVRAKAMHSVPAGGGGMSVVFVGEDAAQELCESYKLEIAAVNGDTCVTIAGAFSGLDAMQEHLKSKDIRFKRLDVGRAFHTSHMESALPAMLRIAEEIQVRAPKAAPKLISLLSGAAMIEAPGADHWANHVRKPVLFLQGMRSLIQDGRPRVFIEVGPDAALTAMTKRIISTRDKNVALIPSMTQARREDENLRLAEAFGRAYVSGVALNFKALKVGPPVPCSVELPLYPFDETVHVALGQLTSKAMATIGDKPTMAMQQVLSATEAQRMDHGKTNLFEESWLLRKEHRGLRGRNLPPAHTVYICSEPTDAAALASVKTLRERSHTVLVPQDAESAAKAALGEDHFNKANVAGVDLLAGGDELKACLSGPNEADSVAVVYIAGGESGGQAPGLEDLGRLTDTAFGETAQVLCVLRSIADLGQGTRIKLWIVTVRAKAVAPGDRIQSMSATLWALGKSAMQESFPSLWACMIDLPGPGKDQLALLPSSTGNSAADFKVAVPAAARLLQILDIETSSYSRTDPPEQLAFRRGQWLTMKLREAELQHDIDPAVLKKVEEATRANVFPPPGVEVQTRKTLTPDAWYLITGGLGGLGLNAANALVRHGATKLILTSRGGKATAQYKPDLDALSAIPGITVRPYACDTGDRAAVFKMFQEFEADGGIRGVVHCAGILADGNIRNQDVDKLGAVWGGKVDGAVNLHMASIRMSRPLDLWLTYSSSSALMGSPGQSNYSAANTALDCIAKLRRQVGLVGTSFQWGVWVGVGFAEPSFLEQLDSVGFPSITKSLGSLVLSTLLNRNALAMPKVVCCHPVKWSVFVQRGPEYMMSGDLECFEAVQNRIPPKKEPVPLTDDMKAYGALETASERTEMVENVLISSLKKATGKEITKTQNLGECGIASLEAVELIETLVRRFPVNIALGKLLEYPTVETLSRYVGGQLDRIVDSKRSMPLSRGQEILLAQGLSRSYIYQEMTFHGPLAPHALLEAWKQLLGRHPVLRTILDLKPEEGIGRQQTLPLEDTPFQEMYGLVVTASKAKDTNSLESMLGLAADTMNNIPGARLLSVKFATKISSNSTDSTVILAVPRMLLDNWSLRLLGSELTGLYVMSQAVSSAAPGAAGPTLSPPLTSYQEAMKLAAQKESMTPGTVSPGVRSLVRSGSSIASEKARILVPMTITGLSESNKPKDDSQSVRFTLTPALAAELSAHTIKSRIPPSTIFLSAYLISLWERSENTDASVLVDLDQRVARGDVVGPVLVPFNVTLQRAHASRGPGELAYHVRESVDEALQLLQAPSTRTTEGALRAIPEGVPGFAFHEIPLGGGEVGMIGDKKIQGLQLSVVSSLANDRKNTEYALNVATGPGYTMTDLGGFMDRLAFNIREVLLPMASRKKKDTPYTIPVAQAGAVGAAGALTAKHVSLSIDQGSAAAASGDEAHVHGTPLPVLLIALLQIVGIAIMGTVLAVPILLVWPLVAMALSDLGQAATLALVPLFYHLIGLIIAAEVLVLRELLTRGRLTAGSYTVNSLPFLRWWFMSRLLSLTSPVYVDHMKNTIMYIWWLRALGANVGEKVRFHAGVVLTDPDLITLGDDVVLGKGARLVGSIVRDGVLIRGDVRVGNRGHVSTQAVMMPGSRLGQDSLLDRLSVAVEGQQLAENSVYESSPSRFRRPRDDVDTAAHQLDSPVTISLDAFSFILQALLAPILATLAAAIAYQPTAALAVTLKLFPFFDWSNWPEGPVIFALFSTVGVVPMTAFPTLFASMASLRATAALLPDSVLLYTARQAGFPGATAEGIRNLFKTQEGVDTIKGGLPAGMTLEGTPGTDSLVFVTSGKVAVKQVMLDAFGVPAATLYGIFGIVWIFALGFLIQGFVLTLLTNLVYYILLAPPVSSNAYRVRGFKAHLRQVKISVLRWTYDRFMRLFVGTDFLPTWYWTLGAQIGRNVVIANTDVFEDPHLISLGTQSTVTDYAALETTNEPGNGYVVCGRVKIGRDCVVAVRAVVAPGTELADGAIVMPQSVVSGGKVAADAVMMGVPAIKILDRSSLPGNAPADDSQGPVTLGGCLKWGLGSCVYEWLVMRSIQGLVVPLVSCVMNLLLVLASAYPPLLFYLWAMAETGAKGAGWSVRLAQVATPIAFLSFWICILVVVVLHKWVLRGRQTEGTIVPLRGPSYHARLQTLVLQNYAGVAALETLRGSVFAPWYLRLLGSRTDGSAYINTLTITEPDLLTVGKQTVLDQDAVIMPNALEGRALVLGPVQVEDHARLGAASLILRNCSVKRGAELAETAVLPPTLSIRVKGVRYGAFVLEDATDEESA

SEQ ID NO: 8776 - protein, 383 aa, Nannochloropsis_gaditana
MLESINEFFKPFVAEHSVAVADGMDYKGTAADVLKIMKNSDFEAHKDKDVHSSVSEYASLFTGARASVGRISTDASIKTRQANYQKLVTNFYDLVTDFYEYGWGQSFHFGPRWQGESFVESIKRAEYHLCSRLGLKPGMRVLDMGCGVGGPMRNMAIFSGAKIDGITINEYQVNIGNKYNAQRGLADQCQARQGDFQNLPWPADTFDAAFAVEATCHSPDKRRCFSEAFRVLKPGGLFGNYEWIVTDKFDASNPEHTRIKEGIEVGNGLPTLATAEQVLAAVRAAGFEVLDAYDANADVHSPHQIPWYEPLTGKLSWSGFRMTWLGRIMTHAFVTVLEAARIAPTGTGKISGILNATAIDLVEGGKAEIFTPSFFFVARKPDL

SEQ ID NO: 8777 - protein, 390 aa, Nannochloropsis_gaditana
MKAVTVLPLFVACLVVKTTFSFLPCPLPMTRYATAKWFVPSFQVATPYQSRSRLQMLHTSPVAGKPPSQLTVAVAGATGYIGKAVVRECVRRGYKTKAYVREESIERAKSLDYLKGAEVIGGSLDDSAEVEAKLFQEPVDVVISCIASRSGAPADAWKVDHQANVHLLDASLHAPTPAQHFVMLSAFCVRKPELVFQHAKLKFENYLRGKQDEITSTIIRPTAFFKSVSGQLEIVQKGYPYVMFGDGEICKCNPISEADLAEYIVKSIDDQSMHHQVLDVGGPDEGLTPKRQAEILFEVVGKEPRFIAVPIGLFDAIIGTIDFFAQFFDGAKDAAELARIGKYYAVEDMLATGRGEQYGQITLREHFARIAKEGNEYDPYTTMFSSKKEA

SEQ ID NO: 8778 - protein, 225 aa, Nannochloropsis_gaditana
MSAETRGDGTTRNLAREFKRAYLSSYNLAQTGLWATVLALTLSALFSNVHDYGGVWAAAGPAAKLAVAGAWLELVHVALGLAGGSVSSAFWQNFGRTFVLFAIVDSFQTPRTVAWLPALLVAWSCGELVRYPFYLMGSNAPPALVWLRYSAFLLLYPVGMASEVALLFLTLTEAREAVAREDKFCLRLPGKGASWRILNFYYFLLFGLLVLYPFAIPYMSSQIAG

SEQ ID NO: 8779 - protein, 496 aa, Nannochloropsis_gaditana
MTADDSSFLTPPHAVTIGVVAACLLAIIFIKAKSSSTSTTLDSKAPVPVLVEVPDAVLNRRFKYDLPNRALVTGGNGFVGRRIVAMLLEQGCDVTVFDITKGFEDEPRVKMVVGNLVETADVAKAVEGIEVVYHVAAPHASHPPAVQFAVNVTGTRALLQASAAAGVKKFVFTSSASVVYEGGNQAGVDESTPIPTASLDSYTKTKAEAEALVLAANGQHGMHTAAIRPHGIFGPGDRQFFPVLVESARKGKTKYALGEGRNVADFTFVGNVAHAHLLAAEKLGKVPGVDGQAFFVTNDAPVPFWDFLAQVLTGFGYPAPSVRLPAGLMTVVGGWMDGMATLLRMVGVRFQPTFTRSRVQYLTTHHYYSIEKAKRLLGYAPAWSQEEALALCFQCMMPALANPRAPKPRRVTVKKGQSVPVYRMQQVSRHNTRGDAWIVVDGKVYDVTEYVDVHPGDDAILRFVGGDSSKGFHGPQHPVSVWDVIAEYEIGAVAAE

SEQ ID NO: 8780 - protein, 295 aa, Nannochloropsis_gaditana
MSSLALTPFKAGLFVGKSIIVTGGGTGLGYAIAKELVSLGAKVVIAARRIEVLEAAASEMNKSSQRGGKIYVCQCNVRNEDDIQKLVTFALETMGGIDGLVNNAGGQFVSPVENISARGFKAVVETNLLSCFMLSKEIYNRWWSQQEDRKRSGSIVNIILANKNGFPMMAHSGAARAGVENLTKSMALEWIGRGVRVNCVAPGIIYTESGFANYGEMAGAFLSSVLPCIPAHRCGTAEEVSSLVVFLLSDAAVYITGQNMGVDGGMGQGTIPLRPQDHGASLLPVYGELPMKARL

SEQ ID NO: 8781 - protein, 1041 aa, Nannochloropsis_gaditana
MSVTAEVFPDKRVAIIRFSNPPVNALSKKLCTRLKEAVANAQQDTNIRAVLLMSGEGLPFSGGADIKEFDNPPSRDNAEVGPLSLLIEEIESATVPTVACIHKYAFGGGLEVALACHYRVSMPTALLGLPEVKLGLIPGAGGTQRLPRLVGWEAAVRMVLTGDPLPSTEAHGIGLVDAVAKGGKEAGAALQEVALTVVNDPKTGCHRRAIDLPVPSNALNPLETCQTFAKKAGIKVEASDRGGEAFQGALEALAAAALPDPRRGLDLEARVFNRLLRSEQSKARRYVFFSERRVASDHHLGLRGDESLVEIRHVGVVGGGTMGAGIAIAFLDAGARVTLVEVTTEALARAHEVVQGIVASRVRRGLMSAAQAAVWASQRRFQGTLSLGDLSETDLVVEAVFEDMALKKDIFRRLDAQCRPSTILATNTSTLSIDDIAAVTRRPDRVLGMHFFSPAHMMRLVEVVRGQASSTAVVGALAAVIKRMKKVCVAVGNCDGFVGNRMLFSYQKELQLMVEEGADPYRIDKLLFDFGFPVGPFVMSDIAGLDVARRIKQQRQQRKLKQSSTGRDNLSSERDSDVADKLSESSGRLGQKNGRGWYRYDPAIGKGRTPLPDPSVQTFLENFRRSKGLTPRNPPHTDKEILERSLFPLLNEGIKIIEEGIAKSGSDVDIVWIYGYGFPAWRGGPMYYAEHHAMWATVGGRDTMWLSRYVLFLLWSTAAGDAWGPPRSPLLQRRERMPSGLYTSHTGLAYCSQPSIKAAKPFDDDPAWFPSPSSFSATHHAGFSPSSTLPGPATTTREAHALACLDACPLVAVLRGVTTTDMYETLQTLRQAGLTMVSVPAESPAGFEGLKALASLISSSGAASSFWPSHAPTSGSGCDETLPPLALGAATVVSVAQVDLAAAAGASFISCPHTDPDIILRAHKHGILCLPGILTPTEAFLALKHGAKVLKLFPSQAVPPGMVASIAAILPPPTRLLVSGGVKAEDMPAYRAAGAKGFALGSTLFQAGLKGGELASRARAFIQALERAPDGEMEGEAVRGG

SEQ ID NO: 8782 - protein, 343 aa, Nannochloropsis_gaditana
MGRYYRSRHLSALGAPPRLSLKPDEPRRCHVQQRRTLAATPHYDIKKVGVVGLGLMGHGIGLVSAQAGYEVIAVEAQAPALESGKKRIDKSLSKILSKAVEKGKMTLEAAEKEKEKVERRITYSLDLAALRDADLVVEAIVENLDVKIPFYKQLGSLVKPTAIFGSNTSSLKIGDFAAPSGRPQQFVGLHFFNPVQLMRLVEIVRLHETEPAVFEAVRGYVARIGKTAVTCQDTPGFIVNRLLVPALVQAMLMKERGEASVEDIDVAMQLGAGHPMGPLHLADYIGLDTCLFILEGWVKKYPNEPAFIVPSSLRALVQGGKLGRKSGEGFYVWEGDKKVKPAM

SEQ ID NO: 8783 - protein, 704 aa, Nannochloropsis_gaditana
  misc_feature (693)..(696): Xaa can be any naturally occurring amino acid
MSAHQIPSSHNRASTSPPLSVGIGWSICLGFGAVFSLFTTLLVWLEGRYSGTKQSSEHFNTAGRTVKTGLIAAVVCSQWTWAATLLQSSNVAWLYGVSGPFWYGAGAAVQILLFGILSIEIKRKAPHAHTVCEIIRARWGPTAHKVFLSFCLLTNMLVTSMLLLGGAATIEAMTGLNVYVAAFLIPLGIIVYTFADGLAATFLSNYLHTIILHAVLLVFIVAVYLCPLPGGRSQLGSVSQVYDRLLRLNTYTVEECAARNFLDDTGSVAGCGPVPGNKAGSSLTMFSQGGIMFAVINLVGNFGTVFVDQAYWQAAIAARPSAAVRGYLLGGLAWFAIPFALATSLGLASLALELPLTAAQANAGLVPVASAVELLGTGGGVLMLLMVFMAVTSCGSAELIAVSSLLTYDVYKTYLRPGASGAELLKVSRWCVVVFGLTMGGLAALLEIAGLALGYLYLLMGVLVGSAVFPIATSLLWRKTSAHGAMAGAVGGMLIALAAWLGTAAAFAEKGGPLLTLETTGASVPMLVGNVTALLVSMGVTSGHSLLWPEDCDWSTTRTLQEIGSVADTQAGEVAPREGEEVAPRLQAETEGEMAVEMDPKRLRAAKTFVLKWGCFFSLLMLVLWPLLSLPAGAPFSFSYFSLWVWVGIIWGFLSSIIITAMPLRESKAAIEQVLVGIWADLRRVGKGKGGGXXXXRERFNRTP

SEQ ID NO: 8784 - protein, 293 aa, Nannochloropsis_gaditana
MVSLFIHFTCLLPLLIGTPVTRAFMPRLNGATFLGPSNALSPVNVAHSRNRGIFCMRSNEMITVEGVSVVLLAGGVGKRMKADRPKQFIELLGKPVLLHSLEIFSTLPGVNRIVIVLDKSYRQEFSFLQEEDPRIVFADPGKERQDSVFNGFSQTLPDASVVCIHDSARPLVSQSAVLASLRDGSVHGAAVLGVPMKATVKESADGEFVLRTMNRSRLWEIQTPQVIKPDILSEAFALVTEKGLEVTDDVSMVEQVGRPVKLTMGEYTNIKLTTPEDIGVAEGFLRERAEGKL

SEQ ID NO: 8785 - protein, 1149 aa, Nannochloropsis_gaditana
MEAGRRVDVATRLLAAKNVPLLVAAPLLLQDLSSWRERGVLGLQSAVLYSLPELDGAVDTVVLGGLVGDKIAIVPERARKLARRILGWHQLRVTPAKEKKVSILCYGFPPNVGAIGTAALLNVPRSLEKLLIALQEQGYDTGLDARKIDGESVIAILTAINQEAVVAGGPKKMHAMVEAGTFDGGNGAAGGEMLKARITAEGILPGAFRAAVGERTAARVEKMWGELEGYVGLFTSQAGELVVGGVQLGNVWIGIQPLLGIEGDPMRLLFERDLTPHPQYVAFYDWMRNSFKAQAVVHFGTHGTAEWLPGSPLGNTATTWPDILMGEIPNLYVYACNNPSESILAKRRGYGTIVSHNVPPYSRAGLYKDLAQLRELVSEYRENSEANAGLRPVIVGVLERTGLWEDCPWPSPSSPEEAASVDAAAFNAYMGRLASYLGVLEQRLFSEGLHVLGETPSPRQVYQYLDAYFDQDLPPLLLEAIAGLPTPPAASAKSLLSDLVASCRASSPSSPPSAPLSAEGGQLSHGSGPGECGVEDVTEALLRELERGDGRPVTHWYNSLSNEEKYAMTLYRPNDLLRFYSLRLRRAWGDREAKARLEEEVAVGWGTMEEIAEAPSENVKEGLRERVVEAIEIKKMLEQNTEELASLVKGLNGEYVLPGVGGDLLRDGLGVLPTGRNIHALDPYRLPSPGAWARGQEAVRKILAQHQAADGGYPETVAVMLWGLDAIKTRGESVAILLALVGARPVKEATGRVVRYELVPLAELGRPRIDVLASLSGIFRDSFSNVVDLLDDLFERAATAEGESEDMNYIKKHANKLKEQGEDRPTARLFSNPAGDYGSLVNERVGNGEWEQEEELGETWASRNAYSFGKGERENGVKRDGVLKELLGTTERIVQEIDSVEYGLSDIQEYYANTGALKKAAENIANAPDRSGKNTAAPPRAQPAPSQGRADSDQQGGKGEEKKKRVVKVSIVEAFTKDVAPQELEATLRLEYRSKLLNPKWAEAMAAQGSGGAYEISQRMTALVGWSSTAGFRDQWVYDGAVERYVLDEKMAQKLMDNNPEAMRNVVKRMLEANGRGYWETTPEVLEHLREMYAAAEDEIELSGGKGVRKKVLREDGGEKSAPTPREEVKVVSAMMKNLKEERAPVVSR

SEQ ID NO: 8786 - protein, 1360 aa, Nannochloropsis_gaditana
MKTGFVDAASACSSQTGASKFVAEAAFGIENALENSLCFWLEYAGLTHELALEWARPLLISGLVILVLTVVAWSRRLVEALESDRPNYTDVKGRLNNPTYPTLASIKDDPSHYQPGSHNSSLYGGGRRPQNVGILAAEIYFPSTYVRQTLLEKAHGVSQGKFTSGLGQAGMAFVGDREDINSIALTVVENLLNKYEIPREKVGRLEVGTETLVDRAKSTKTVLMSLFEASGNTDIEGTTVVNACYGGTAALLNALAWVESSGWDGRYAIVVSADIAIYADGPAKPTGGCGAVALLVGPDAPLVIDPQLRATHASNTWDFFKPKFASEYPEVDGKMSKDCYLKALDDCYMRFAGKQEEAFGKPFKADAIDYFCFHHPYNKLVQKAFGRLFFMDARRGKLKKAEGWESLDPWISNSLEETYDDRDLETLLRGLSHDRFSKRVAPSCLVSMQVGNTYTASVYMNLVCLIAQKAEALVGKRILVYSFGSGALATIFQITGRQPSSSVNASRFTLAKIASAVNLMDRLLERETVTPEELSEAIRIREKNVNRGGFVPQYSVSSLFPGTFYLEEVRPDFTRVYLRKSSTAPRIKGLFYPVHGFSKVIMVEKVLTTPRDGEGEQIFSPFVRELELPEDEDGHEIISSCASSNSPNSSIVSTPSPKKTASSPAAKRTETVLAPGHNSAYTCSTHSHVGNTRAFTFPSVPETQALCLGSPSCGVSASVPTITRSSSSLQATTPLSTKSSALLSLTHEEALMSMLKASLTTAAAPPAHQHAKSPIVISGVAAGLPGKEREVFSATNLADLVNGTNFITSLSAETKAELIDRNVVQLKKNPDGSSRKVAVDSDEKVMKLGAQLGKFDLTLYGVSPAMVATMDTVVQVAIAAGLEALKDAGIVEGTHKNLASWQLPEHMRDGTGVVYATSFPALEAAVSEVMRFLHSKQKSLTQSKALLDSVKKQLVATCGGWEHVGPEDKAAYEQLQKSLEADLNDPDAEYEFDRKFLFRILVLGNAQLAQIVGARGPNMQTNAACAGTTQAIAIGQDIIQQGRCERLVVIASDNASGDVLIPWLGSGFRALGAASIAATVAEAAIPFDKRRTGLVLGAGAIGMVLETEAAVARRYAEKTGLLSLSLTRNSSSASTTSSASSLASRSGPTATISEQHIKDFGLALRIRLIDTQYSNSAYHGAALDQHHIAGELERFLVALEKKFGITRQAIAREGVYLSHETSTHASDASSCAANEIFALRTCFGEEGMKNLVILNTKGYTGHPMGVSFEDIAAVQILRSGIIPRVANLDEASTDPYLGSINLGRGGKYAARYALRFSAGFGSQVAFALYGHFGGEVSGGVRGEEAEGGYYAGVHSTGAQP

SEQ ID NO: 8787 - protein, 698 aa, Nannochloropsis_gaditana
MTQSCSAESLGAGAWLVGEMQEIVHAVAAAADSIHLPLGAYNGPVLVLFKAILVVMVVYFVLLYLERRHKLVSDCRTGLAFLSVLFDMFVFNKPRTFARCFADAVRKWPDKVAVQFVDDGRELTFREIDLRANQVAHLLAQHGLGRGDVGAIMMTNKPEYIIVELAIAKLGAVSALLNFNLKGEPLRHSLQVAGAKLLVFDDELAQVVLPVVQAFSLAKPGEENGGPVKGKPGRGKGAPAAAGGTIPALFVGPGDAAIRKWAVSLDKGVAMQHETVPDPSILSNQSQNEPMSLVYTSGTTGLPKAAVVKHKRVFLMSMSFARQFAVRHSDKIYCTLPLYHSAGGNIGLGIMVNKGCTLALRSKFSASKFFKDVHDTGATVTQYIGELCRYLLATPPSPYDRKHKLRLAFGNGLRPDVWPRFVSRFNIPEIGEFYGATEGNVVFFNYWGRGEPSGAIGKGGFFNRIILGWTIVKFDPIKEEPIRDSMGRCVPCADGEAGELLARISGTSEFSGYYKNKEATEKKVLREAFGRKGSHWFRSGDLIMVDEQSYIHFVDRIGDTFRWKGENVSTTEVALALGRVDCLEEVNVVGVEVPGKDGRACLAAITLRDGKELDLDMTLEEARAHLPAYAVPLFLRVLKKGTQETTGTFKHMKAKYRTEGIDAGAIADDMYWLDPSEGVYKPYGKAEYQKIVSGKAKL

SEQ ID NO: 8788 - protein, 463 aa, Nannochloropsis_gaditana
MPLTSSSALAPGSSRAQSKTRRIEWFRGIREDFSNRLPLYKSDWVDGVKGKTLPTILFLYFACLAPAVAFGGISYGLTQGAMGVIEFLVSCGMSGMLYAIFSGQPMTFIGPTGLTLCFMAALFNFCSSFGVAFMPMYTWVGIWTSLMLGLLSSANACSLTKHCTRFTDEVFNALLALNFIYEALKNIAVRFFTTGTDKTQPLLALNMALATFALSQRLVSYRSSILFTHRIREFLSDFGPALTIIIMTFVGSLPMVSSLGIEYLKAPKRFQLGNGRSWLVPLWDLPLWAPTIQSLNHVRSVTDYVPAPGPVTVSESKGGPDEQQRTTYVMETRLTGLGIHAMVLCSIGLLPLLRRIPTPVISGIFLYLGRTVMTGNTFLQRIKGAFFDKSMLAADSPFKILGRATVNKYTSIQMGCLAVLWCLKSNPATGMFFPSVIGLLILTRILVIPRLFSKGEIAVLDDS

SEQ ID NO: 8789 - protein, 483 aa, Nannochloropsis_gaditana
RGRGSSALAYPLPSPIKLHTRGRRPDFWTSIAMSPTFRRRHSNAPFKLQIFMVKLLAVVALLGCCCLHGVASGTPPHAAFVPRASTKSLGNRLAKAPQARREQTIMQLSARRSRSMRPLPYPVRFAVLGGGSFGLALASVLGKKSIPVTILVRKEEVAEHINLHHRHPTYLSDIALAPSIRATVHPEEALRDASFIIHAVPVQYSRKFLEDIAPHVPKNTPIISTSKEPTCVHLEGVHANSPFQSPLPQGIETGTLCMMQDILLETLGPNRETAYLSGPSFAREIALGLVTAVVAASESEALANEICDIMGCNYFRVFTSTDVVGVEVGGAVKNVIAIAAGMCEGLGLGTNAMAALVTRGCNEMQRLALSLGARPSTLTGLSGVGDTFGTCFGPLSRNRNLGVRLGKGERLENILGSSTEVAEGHATAFSLVQLIEKTNRAYRRELEFPIIYGVKEILEGKRTPAEGLRDLMAMPVRVEMWNL

SEQ ID NO: 8790 - protein, 329 aa, Nannochloropsis_gaditana
MKISTLCVLTMGMAAASASVSSFSSSSKPAKTLSTVPRLVSKVRGGNDSPASIVPQPLMKAPADAYKTVLALGVKKACQPASKILLLGVMAGLQVGIGAAMAVATLGGVPLMQEQNPALAKLLFGIAGLPCSLLMVMATGAELFTGNTAVVGTAFFEGKISLQQLLKSWSCSYAGNLIGGGLLALLCNYAGVFSQAAGTFTAVADAKAALPFGVAVARGIICNWLVCTAVWVSTAAADLVSKAVATLMIITIFASLGFEHSIANMFVGPFGAMQKTSRTGFVAFFVKNLVPVTIGNILGGSFLMAGMQHLAFGGRDKTSATTTPVNKRE

SEQ ID NO: 8791 - protein, 326 aa, Nannochloropsis_gaditana
MCPGPQDGKGTGLVENPLVAAAAGLYAETEQPDKDEGVWDFFRSYTDEPHKSRSWPPWSFATAPFPLLLFLTYTLSGSCNHFLTLIMHEVAHNLAFKRLFANRVFSIIVNLPLGIPAAISFKRYHMEHHKYQGDETVDVDLPTDVEGKLFRGGPLKLLFVFLMPAFYSLRPLFVRPKKPSNWELVNVLAQLTFDALIFYILGWKSLFYLVVGTLLGMGVHPMAGHFIAEHFVYQAGQETYSYYGPLNWLSLNVGYHNEHHDFPNIPGTRLHQVRRLAPEFYMPLPHYYSWSKVIWDFVTDPAVTPFNRVKRNNLSEADRMALAARD

SEQ ID NO: 8792 - protein, 620 aa, Nannochloropsis_gaditana
MALRKRIADLVAVITLVQSTYSIATAFLLPHTTRVSQPLRSTSPASTTRAPASTLPVEQVRGSDKEKLLDLSVLDRAMSGPPANLRVKDTSTERLRVGIIGGGLGGLITAMDLSEAGHEVEIFEARRFAGGKVGSWVDKDGNHIEMGLHVFFGCYYNLFGIMKRLGVFESSLRLKDHTHSFINKGGRVGELDFRFGGIGAPVNGLKAFATTSQLEIGDKIANAVALATSPVVKALFDFDAAMEDVRALDGISFSEWFLRKGGSRGSMTRMWDPIAYALGFIDCDHISARCMLTIFQLFAVRSEASVLRMCEGSPNTYLHEPILAYLKARGVTLHLNSRIQDLVYDTDASTGAPSRVKGLVLSGKANTEDGKEAGAAGGVGTAGEQRLFDCVVAACDVPGIQKLLPESFRKIQEFDNIYRLEAVPVTTVQLRFNGWVTELNDPVRMKEINGDFSDGRAPGLDNLLYSADAEFSCFADLALTSPAEYYKEGEGSLLQCVLTPGDKWMPVSTEKIAEATLKQVLDLFPSARGLECTWTNVVKLGQSLYREAPGMDVYRPKQKSPVENFYLAGSYTYQDYIDSMEGATKSGLLCADQILRDAKTIKARASSKEDMIKEAAVMSA

SEQ ID NO: 8793 - protein, 279 aa, Nannochloropsis_gaditana
KGKQQVKRPVRVTPSGMELSLQGSRRAFITGAGSGIGAGIASSLALEHGWEVIATDVNLEAAQGTAAQIKAKDGKAEAYALNVADNTQIVSLIEQLKREGKNVDVLINNAGLQHVARLEDFPAEKWGFMIQVMLTGVADLTRAILPMMHEQGFGRIVNIGSIHSVIASPFKSAYVAAKHGLIGFSKVIALETSDVDITINTICPSYVKTPLVDAQIANQAKTHGISEDEVINKIMLEPMPKKAFISIQELVGTTLFLTSDAARNMTGQTLVLDGGWTVR

SEQ ID NO: 8794 - protein, 274 aa, Nannochloropsis_gaditana
AVHGKEGMADFVIHRNDDNQEKYFQEERPSPGILVLLLDRPRKKNAITGAMYLDLADAMDRAAMDESVTCLVLTGKGDYFSSGADLTDESWTPDPEHKMETSPAAIFMKALSHFPKLVVAAVNGPAIGIAVTLLCHVDLAYAAPHATFWTPFLRMAIVPEYASSALFPLTMGRSKASELLFLGKKFTATEAQASHLISEIIPTDRLLTEVLLRLEDMLAKPLVQKSVVAFKALMKSQRLREVDDVIKAEFRAFDDRIAEGDVAFAIGQLLQSRL

SEQ ID NO: 8795 - protein, 328 aa, Nannochloropsis_gaditana
GMRSFQGVASLQGKNFMNIDELTDVELRDLLSLSAQLKKAYSSPSPSVLPRPCEGKSVSMIFQKRSTRTRVSTETGMALLGGHALFLGPQDVQLGVNESMRDTANVLSRFNSLILARVFAHTDVQLLAKHSSVPIINALSDLYHPLQALADLLTLEEHFGKGSLQGKVLTWVGDGNNVLHDLAMGAARLGMHVRVACPVGYEPNGEIMHRVEWHAQRSGGSYVMERDPMTAVAGAHVIVTDTWVSMGQEEEYERRMRDFEGFQVTRRMMEHGAKGSNAGRPACVFLHCLPRHPEEVTDEVFYDPARSLVFPEAENRMWTVMAVMLSLV

SEQ ID NO: 8796 - protein, 443 aa, Nannochloropsis_gaditana
QLLPGDIAWMLAATALVLLMTPGLAFFYGGMVRAKNVISTLLMSFVAMGVITMLWTVVGFSLAFGDSLSGYMGNPATFPFYNNVGAAADTNFSNTIPLALYSLFQLKFAIITPALISGAIAERVRFTSYIIFIVLFSLFVYCPLAHMTWHPDGLLAKAGILDFAGGTVVHMSSGYAALVVHMSSGYAALVGSIILGPRKNVGKMQPANIPFVMLGTALLWFGWFGFNAGSALAADPVAVQAFLTTNTATAAAMLTWVFVDHLRGSKSTAMGACVGAVVGLVVITPGAGFVTVGGAACMGMIGAFISNVVAHYFNTKANIDDTLDVWPCHGLGGTVGMVLTSCFATVSANADGADGLFYGDATLFWHHLVALVCLIPYIMGMSFLCYQITNLIYPLRVGEKSEKLGLDMSQHKESIMVHDEEEDDVVKPADDLDASSRIELGSM

SEQ ID NO: 8797 - protein, 296 aa, Nannochloropsis_gaditana
LRENNSAADMHPRAASLGGKSRIFASRALVRIFHRPLGSAHKPLADRDPVLVSFARTPIGKFNGSLASLSAPQLGAVAIKAAIARVGIQKNDVEEVLLGNVVSAGIGQAPARQASMAAGLPVQTIATTVNKVCASGMKALTLGAQSILLGHADVLVVGGMESMSNIPYYLPKARSGYRLGHGQLVDGVIFDGLWDPYNNQHMGMCAEKCAKDFHLSREAQDAYARLSHARTKAAVEQGLCKEEITPVSIKGRKGEVVVETDEQYTGMDPAKLPTLKPAFLKGEGTVTAGNASSLND

SEQ ID NO: 8798 - protein, 296 aa, Nannochloropsis_gaditana; identical to SEQ ID NO: 8797

SEQ ID NO: 8799 - protein, 391 aa, Nannochloropsis_gaditana
MSSHMPVCRGDPEAGVVPAGGTVGNEEMAGRENGGSGMYRLAEDVDGNGRDEGCQWVPPALRTSLERYRWLEIILLSVIVILAKEGFGSGVKNHRQYIPLVTQVLPGGAVVVLGNATAFSYPVRFREGTLECPPVTLEFCATSPESALADPCCEFMTTGAKPFQTVSHDDLIWITVGLPLILLVLRHLLLKWYLCSVPASSADPMFSSEDKSALRPLSGLPFGYSATFCLRDVLIGLFFSLALTRATTNSLKMLTSQPRPNHFALRLFASLSPDSSAAIHYAESAWKAWPSGHSSMSMASGAFLSLVLLRDLRQFAGPLQRQLRACLVILALGPVYLAMFVAGTRVHDYFHTTADAVTGSALGLLWAVLAFYQVVPAGGLEVRANPPLKYL

SEQ ID NO: 8800 - protein, 272 aa, Nannochloropsis_gaditana
MKAVLAAKLVSSAFLGALTRKHLFVHDGFSPLGVQRVHTRRDTVRNDHYAPRRRPSKMFMVHETLAEVTPALLAQLAGCAVLVGTGKVFQQKEEEEGIEPVAPWAPKDGTETKDIDLYRDTAVRYFGYANEVGEAFRPVVPTILVTFSYTVAFVYILADSYSQGTKVADPISGVWKKPSFLAGVDSLLFQIMASVIFPSFAINRWVTFLGAALTYLPEGELPVQVLDYFPTATGLLLIPVICGPLDILTHRILDNSFRSVSETILRKERFLE

SEQ ID NO: 8801 - protein, 98 aa, Nannochloropsis_gaditana
LKKPVKGSLAMMNDILLETLGAREMAFLSGPSFAKEIIQELVTCVVVASESEALANEVHDLMSSSYFRVFTSNDVVGVEVGGAVKNVIAIAAGMCEGL

SEQ ID NO: 8802 - protein, 772 aa, Nannochloropsis_gaditana
RENNRTETQSKMHGCFTRWGAFLVMGMVGMRVAKAFLSPFCPHATAECPSNAAFTTSSSCTGHAMRSPPPLFHLPGFSSARHAHSSTARAASVEGTEASRGVEEVVFHPADEYFQQVPHHYDHVEDYLVHYEKSIKDPEAFWSEIGRNFHWETPWEETLSYNFNRSAGPIHVRFFHGGETNIAYNALDRHVAAGLGDRIAFYTERNDLEPIRESGPGGLKDQYTYREALEEVSRIANVLKSMGVKRGDTVGLFLPMVAELPLAMLACARIGAVHTVVFAGFSKEALADRLCDAGCKAVIACDGVFRGSKLIPLFHTVDAAIQLCNERGHIIEHTLVLERLGGDVAGVHLTPGRDVWWHEATAKASSACPVEWMPSEHPLFILYTSGSTGKPKGVLHTTGGYMIQAATTFRHVFNVRPEKNDIFLCTADCGWITGHSYVTYGPLLNGASQVVFEGVPSYPDVGRLWHMVDKYGITHLYTAPTAIRSLMREGDEHVTKYARSSLKVLGSVGEPINPEAWKWYHEVVGGGRCPIVDTWWQTETGAIAIAPLPIKGWGQKPGSASLPFLGIEPVLLSQDGKELEGPTEGLLAIKSPWPSTLRSIYGDHERMEQTYFSFDGYYLTGDNARRDSDGYYWITGRADDVVIVSGHNLGTAEVEAALAQHPSVAEAAVVGIPHDVKGNCLYCYVTLKAGQAPSPDLEKQLKVSVRNQLGAFAAPDFIQWAPNLPKTRSGKVMRRILRKVAAGGKAINVEDLGDTSTLADPEVIKELIANHV

SEQ ID NO: 8803 - protein, 2193 aa, Nannochloropsis_gaditana
RENNSRLRRHFSSPSWACPGSFATLVVFEPGSVRHRQIRLGSSLSVPLVERDTIMASFPPSNRRATPARVMVVIFSSVLILLAGPVGDAWRMPSIAPGQSTGVAKTSRWAGFLGNFARRSPSISTSPSLPPSLPASSLGPLSAATMAPPSTLSPAAQKKKDAVAAYVKSRGGNLGIRKVLIANNGMAATKSILSIRQWAYMELGDDKAIEFVVMATPEDLNANAEFIRLADRFVEVPGGSNKNNYANVDLIVQVAEREGVDAVWPGWGHASENPRLPNTLKEMGIKFIGPTGPVMSVLGDKIAANILAQTAKVPSIPWSGDGLTAELTAEGTIPDETFQKAMVRTAEEALAAANRIGYPVMLKASEGGGGKGIRMSNNDEELKNNFVQVSNEVPGSPMFMMQLCTQARHIEVQIVGDEHGNAAALNGRDCSTQRRFQKIFEEGPPTIVPPEVFKQMELAAQRLTQSIGYIGAGTVEYLFNAATGKYFFLELNPRLQVEHPVTEGLSLVNLPATQLQIAMGIPLNRIPDIRRFYGKEDPYGDSPIEFFEDDYADLASHVIAARITAENPDEGFKPTSGRIERVKFQSTANVWGYFSVGANGGIHEFADSQFGHLFAKGKTREDARKSLVLALKEIEVRGDIRTTVEYLVQLLETDAFKENTIDTSWLDGLIREKSVRVELAPHEVALSAAIARAFARSQEEEKKFVENLGKGQVSIQSIRSINSFPMEITYKDSKYSFLCSRIGPDKLRLTINGQVLETKVRQQPDGSLIAEFGGTTHTIYALEEPLGLRMVLDGVTVLLPTVYDPSELRTDVTGKVVRYLQDDGAEIQAGQPYVEVEAMKMIMPLKASESGTVTHRLSPGSIITAGDLLANIQLKDPSKVKKIIPFKDTLELAGSGEEPGTTEIESVLKTMNLVLDGFDYEVEFLAQNLVTSVRDGKELLDAAVALVSKYLAVEEQFAGKALDEAMVALVKANKESLGTVLQLATAHRELPRRNKMVSALIRQLQALVERPGTSELALGPLIDLLERTSHLPGKEYGEVAISSAQALLALKAPPFNIRKDELRATLMQTQDNDALARSATLTAGVDLLTAMFTDPDVTVRKNAIEVYIRRIYRAHRILSLSVEEVDGVMVARWSFKFADTPDEESPLRYGFFTVFPSLEAYTEGTEKFSKVLKSSLGGKEVYSEPTNVFHVAVAQLPESDQPEVIANIEAILAEKKELLTECQVRMVNVLFVKGASNPRYYTFTAAENFKEDPLRRDMRPTFPQLLELSRLAANYELQRLPSIGRNTQVYLGTERAAAGVKKRGGSQVLFVRGISHSEQTQTPLGAERVLLMAMDELDYALLDPRVGGSASSRLFLNLLVPITTDPEALAGEWNQVMDRLLAKYATRLLKLGVDEIEIKVRVTADGNTITPVRLMATSMTGEFLRTDAFLEYPDPVNGITKQFCSITREDQICLLNPYPASNSIQTRRASARRIGSTYAYDFLGVMEVSLIQKWDKHLKELSSVYPSRVDDKMPEQLFTAHELVLEDDELQPTQRLVGLNDIGMIAWHATMKTPEYPEGRELVIIANDVTFQSGSFGVKEDEFFRAASEYARVRGLPRIYLSSNSGARIGLVDDLKGKFRIAWNDPANPSLGFKYLYLPPEEYEALKPGTVNANLVETEEGEKRWALQDIVGQVHGIGVENLRGSGMIAGETSRAYDETFTLSYVTGRSVGIGAYLVRLGQRTIQMVNGPLILTGYSALNKLLGREVYTSQDQLGGPQIMAPNGVSHLVVGNDKEGVSSIIDWLSFVPKDKFSAPPILDLPTDSPERDVEFLPTKTPYDPRHMLAGTVGPDGAFVPGFFDRGSFIETLGGWGKSVVTGRAKLGGIPMGVISVETRLVEQRVPADPANPDSRESILPQAGQVWYPDSAFKTAQAMEDFNRGENLPLIIFANWRGFSGGTRDMFGEILKFGAKIVDALRTYRHPVFVYIPPNGELRGGAWVVIDPTINEEMMEMYADKDSRGGILEPPGICEVKFRNADQVSAMHRLDPVIQALDGELQNAKTEQDAAKLTQQLKEREEALLPLYTQVAHEFADLHDRAGRMKAKGVIRDVVTWKRSRSYFFWRARRRIAEDGLIREMQRVDPTLSVQQGREKVSALASPAVYEDDKAFVAWVEEGGEAIAKELEKIKQAAVKASLASLLEGLSAEERKQVLAGL

SEQ ID NO: 8804 - protein, 465 aa, Nannochloropsis_gaditana
QIMMKYAPIAAIFFPALATAFLTPVPAKQQVRMMAATMAPHKTDKSSAVFEEAKNIMPGGVSSPVRAFKSVGGNPIVFDKVKGAYAWDVDGNKYIDYVGSWGPAIVGHADDEVLKVLNEVMEKGTSFGAPSVYENTLAKMVIDAVPSVEMVRFTNSGTEACMGMLRLVRAFTKREKVIKFDGCYHGHADGFLVQAGSGVATLGLPDSPGVPQGSTAGTLVAEYNNLANVEQLLKEHEVAAVILEPVVGNSGFIVPDKSFLEGLRKLTTQYGALLVFDEVMTGFRISYGGAQQYFGVTPDVTTMGKVIGGGLPVGAYGGRKDIMETVAPAGPMYQAGTLSGNPLAMTAGIKTLEILKRPGAYEKLDRLTERLITGILKEGKAAGHAICGGHVSGMFGFFFTEGPVRCFADAAKSDTAKFAKWHRGMLEHGVYLAPSQYEAGFMSLAHTEADVDATIAAAKEVFKTL

SEQ ID NO: 8805 - protein, 699 aa, Nannochloropsis_gaditana
RRFPFLLPPALPSLFPLFSTLPDTAAANRAPLKQQQRRAAAAAAAGEEAAAAARAVAKTAEDPWDGHKNGFDWQLERARRTLEGGPAHSPFRMDYWRPAPSEDGRRAGRLAGGSGVGWFDSCKIFLSNAYQLVTGSKGLDGAPVADVGKYNGSWTNFLAKVMSGQLEELAGGPLFLLLAKYYKKHGPVYKLMFGPRSFMVVSDPVMVKHVLKTHAYKYDKGVLAEILEPIMGKGLIPADQITWKSRRRAIVPGFHSKWLNRMVRLFSECAQVLVDKLDEEEARASVVDMETLFCSVSLDIIGKAVFNYDFGSVTSESPVIKSVYSTLREAEHRSMSFVPYWKLPFADKLLKDQVEFKANMKLLNAVLNKLIAQAVASAEKADVEELTYGRDYEATEDASLLRFLVDMRGENSTSLQLRDDLMTMLIAGHETSAAVLTWTLFELVRHPAALAKVRDEVDRVLGDGTPTYDDVKNLLHTRLALVEALRLYPEPPILIRRALEEDSLPEGGSGLEGGVRLLKGTDVFISTWSLHRSETLWEAPDEYRPDRWLRPTQNPGVKGWGGYEPSHMSGLYPNEVATDFSFLPFGGGARKCIGDQFAIMETAVIMAMLLQRFDFTLHGTVEEVGMRTGATIHTEGGLRMTVSRRQPDRHSHESTSLHPVLATRLSPGGATAASTVGLGLEVGEKVLRKQSEGGCPVAH

SEQ ID NO: 8806 - protein, 429 aa, Nannochloropsis_gaditana
MSKRSRASSRGLAYIQRLHLLSLSLCLLLSLQCSIRAAAFLVPSSPLPSLPSSHGPSLPSSRPPSSVPKSQALRMATSLTEGSSVDAPAAVPGRSFLRAKPIGVGSAAPEDVITNTDLESIVETSDEWIFTRTGISQRRILTSGGQIRALAATAAARALASAGLEGKDIDLVVLATSSPDDLFGDATSVAAAVGATQAVAFDLTAACSGFLFGVVSASQFLHSGCYRRALVVGADALSRWVDWEDRNSCILFGDGAGAVVLEAAEGEEDSGVLGFAMHSDGTGQGDLNLQFSRDDSQSPPSIREVTPYKGKYNNIAMNGKEVYKFATRKVPTVIEEALANAGLGVENVDWLLLHQANIRIMDVVADRLGLSKDKILTNLSEYGNTSAGSIPLALDEAVKAAKVKKGDIIACAGFGAGLSWGSAIIRWQG

SEQ ID NO: 8807 - protein, 457 aa, Nannochloropsis_gaditana
KGKQQLASPSPRKTAYPVTGGELSISERSKPPIVHSLQHVLGSAGFSKGTMVEQTLPTLSQLKKAIPEKCFQKSLLRSVYYMLRDFAALAALYIIYPSVQANFGLAGLFVWWNLAGFFMWCLFVIGHDCGHGSFSEYKWFNDVCGHICHAPLMVPYWPWQKSHRLHHMYHNHLTKDMSHPWMTQEIFEDLTPFEQALLENPLSLFIKYTFLYLFAGKLDGSHVLPTSPLFSDTKERIQCAVSTLCMLVAGVLIYVGLEGGAEGGLARIGSMYLIPLLVFNAWITMVTYLQHHDEDTKVYAEGEWSYIKGALETIDREYGMGIDDLSHNITDGHVAHHLFFTQIPHYHLKDATAAVRQLLTPTGTYKKKQSWNFLGKFTELNYKLKYVAGQGVLSYVDWEAIQKGASPPVCSTDASPATPAAPLPKVAVTCATEPLIALEAKGRSTRKRSPARSSSPP

SEQ ID NO: 8808 - protein, 700 aa, Nannochloropsis_gaditana
TTTNYPSEAKFGDLPYAPGQVKTGTYLRGMDRYKWRTLPDVFETVASLAPEAVAVEDMVHTPTAKMTYGELNRQIGALAAFFQHEGLKPGQCVSVFAENSHRWLIADQAILKAGACNAVRGVKAPVDELQYIYQNSESVASVVESVEQIEALMRTNGGLTGRYGPPRFILVLFPGERSGQEIRELANLPPPTQVLTFDEALSASLARPLTFRPVPKDVRSVATLVYTSGTTNKPKGVVLRHSNLLHQVNYNSFTDSPSKEPAYNPVLGDVLVSVLPCWHIFERTAEYWMFSKGIHVVYSNVKNFKADLAKHQPQFIVAVPRLLETIYRGVLQKFATEKGAKKKIIEFFTRVGSAWVKAWRVARGLVLRSRAPNPIERLLALVLALVLSPLAAVGDKLVWSKVRAGLGGRIKVLVAGGSSMPLVLEDFFELLRTPVIVGYGMTETSPVITNRVAEKNLAGSVGRTARDTEVKIVDPESGARLPEGQPGLVLMRGPQMMAGYKSNAEASKAVLDQEGFLDTGDLGRIHPLTKHLIITGRAKDTIVLSNGENVEPQPIEDVVCANSALVDQVMCVGQDEKVLGMLVVPNVRALARAGLVDRGLAERVAELLGGQVLTNGIAGSRAELEEVEASLREKKEVKKALLADIARAMGKSFRETERVGAVEVVLEPFNMANGFLTQTLKVKRNVVSGHYAQEIEQMYR

SEQ ID NO: 8809 - protein, 217 aa, Nannochloropsis_gaditana
RPSFPRPPPKEASEGDNISLPSSSTVPSLLQGYPLKATAWLAIYSHIGNYWYTHYFYTVLGASYSMPSLRLNDVPLPLYFATFFYFSTYHALSNLLLRRVTSGYQRTPARGIFLLLLLLALSYCTAFMETLTISAFPYYSFQDPFMAFTVGSAFYGLYFLVSFPAFFRLDEFKEGRLSLYQSAMDALGAGMLILILLDAVRLWLGMPLTMAGQALRY

SEQ ID NO: 8810 - protein, 564 aa, Nannochloropsis_gaditana
MSSQLPRPTPPPPPPSGSAAPAPFSIQQAHAVSQNSSNHPSDTSSPSASIHRTNGGMNKGPSPPTTLPTKPSGVKSILTAAQVKMQQAYTDMDGEGRVSVIGVLVLSALSIGTVVMGPSPENLDVNPDIDSGDTAWMLTCTALVLLMTPGLAFFYGGMVDKKNILYTMFQSISAIAMVTCLWTFVGFSLAYGETVGHVIGNPSTFFLYRGVGAQPLKNFGDTIPLGLFSLFELKFAIITPPIISGAFTERISYLPYMCFVVLFSIFVYCPIVHAVWHPEGFLRQWGVLDFAGGLAVETASGYAALAGSIVFNMTGGGHELKNNAPHIPFIILGMSLLWFGWFGFNSGSAFQANGLAMQSFLNTNCAASAAMLTWLLVDKIRGLKPSVTSACVGAVVGLVTITPACGYVNTGGAFVVGVVGGLLCNICCQAIKDSRHVDDQLDVFPAHGLGGTIGVIMTGMLADKNINGDGAWGLFYGGVELFLKNTAAAVGVAVYTFVVSYLIFRFLGSVMDLHIHPEVRRLGLDASFHGESVVRQNRGTFERSLHGVPEYSKHGSEDNCDEDF

SEQ ID NO: 8811 - protein, 181 aa, Nannochloropsis_gaditana
STMGHVGKLDLLKALGELLRLAIPSTFVWLITFYVYFHCTLNLFAEITRFGDRLFFKDWWNCTSFSRYWRTWNLPVHQFLVRHVYFPLLRAGASKMTANVTVFAVSAFFHELLISIPCHVVRLWAFLAMMGQIPLIYITDHLDKTLFKETQAGNYMFWLIFCIFGQPMAVLLYYADFSARS

SEQ ID NO: 8812 - protein, 690 aa, Nannochloropsis_gaditana
MLLQRAPSILLAGGRKALTRPGRILVDNTPRRVTETVPTMAHTAALMARGCGARPSLFMPVLTNPVRTFSVGFGGLQYDTLTEMQEKACKRYGPKPFLGCRPPNGGPFEFITFSDFDEQVNRARVLLHEAGVGRGDKVAAISANRIEWAVSAYACFSLGAIWVPMYEQQRLNECEYILRDADAKLLLVSKERILDKSRHFVSELPALQDVWCFDVDFQPRMKVVDPASFLPSVPIEPEEVSTLIYTSGTTGTPKGVQLSHRNLTSDVKGMTVVIPDEAIPVPRSVAFLPWAHCFGKTCELHNALQRGAQVAVVEDLAALPEALLEVKPTMLYAVPTLFKRVYDKIQDKIQKETPFTQTLIARALAVAEERRSLMMEGESPGPWLGLQYSVLDKLVLSKFKTPLGGELNSSYVGGSAMPVEVANFFENIGVAICEGYGLTETSPLICVNPFDVRVRRIGTVGQLIGDADVRVVRDGVEVEPGEEGEIWVAGPFVFSGYHNKPAETAEAFAELHGTRYFKTGDLGRFVRGGKGVPLLKITGRVKELYKLENGKYVVPALIEKAMAEADLVSQALVYGSDRPFNVALIVPDWEKLRAYGVQHTGGGVTSLSTQEEIGAHPKVQDYVLEQLIVSCKDKLKKYEIPSRVVLIKEAFTVENEMLTQKLSIKRHQVVKKYGPDVEALYSGESKVLVA

SEQ ID NO: 8813 - protein, 445 aa, Nannochloropsis_gaditana
KQTKQSLRENNSNGISPLISTGQVTMSTWSTASNGGPKDSLSNFSSTRRKPSLCQTGHSTSNCSENVRNVNGPRTTSLPKALAIAMAFAAGVLCNPTTAFHVPNFLSLPCIPSQLPLSRTPAVWGGHEGAALLFTGRRCAASITGRCSAAVASAASMPAPEGRKEGEGAKRDEDLPELNSILSKKIVIGNKFLTPIGVYILVSVFAWVILFYPAMLLAAVLSLFTDGGKRMRPVDWVVHVWAMTTMRFIGYVPRIEGRENLPPLEETVMYVPNHTSFLDILTLSGFITRPFKYISKIEILRIPLIGWAMRLSKHIAIRRVSRASQIEMVQQAIKHLKHGNSLVTFAEGTRSKDGRLNAFKKGAFRIAKEAGVRIVPISICNLHKWMPAGAIVPLGVPSDVVIRIHPPVETQNRNENLVWREVFETVNQGLPEYQRYQESSPAPSS

SEQ ID NO: 8814 - protein, 779 aa, Nannochloropsis_gaditana
KGKQQSATGSNTQETAKQETAGSLFVTSPPPCYIPSSARHFMGNNPSTPSNSTNLGVDQGNSSHNTPRANPRSPSPRVNKAKDVEDALLVSHGSSSSSRNSSVGSIDKSNPSADVKGTIMEEKPIFATTTAEEVPPRVLASAHGGPGDAPPVTLYQSFERVVAQHGPRKALGVKRTVPGQALKDTPFTFYTWTEFFATSMRFGRALMTMGFQPHNVINILGFNAPEWFFSYMGAMMAGGLAAGIYVTNGPEACHYITRHSEAMVVVVDDVSQLKKYATATKEQLPHLKALILYGGQALPSDLRMANPDLKLYAFDDFLALADSVPETQIRARAEAMRPGHCVTLIYTSGTTGPPKAVMLSHDNLTWVGSMVVFHFKDRRCTDRLVSYLPLSHIAAQVIDILVPFSCGGCVYFAQPDALRGSLVHTLREVRPQVFFAVPRVWEKMFEAMQQARKSAPLPLRLLSDTLKVTMKTHILSTQYGRDEERPTLLPLADKMFGKVKEKLGLDMGRYCATGAAPLSADIQEYFASIGITIFEVFGQSEATGLTTCNCPHAWKLGTVGRIYPGTECRLEPASGEFQYRGRHVFMGYLHNLKETQEALLPGGWLRSGDVAVIDADHEPDTPKPSGFVRITGRIKELIITAGGENIPPVLIENELKAAMPALASCMVVGDQKKYLTVLLTLHLSESGELMGPSLEAGKAMGSQARSIADVRSDPLWQSYFSAGLKAANSQATSRAQYVQKYTLLEKDFSEKEGDLTPTLKLKRSVVAKKHAALIESLYA

SEQ ID NO: 8815 - protein, 347 aa, Nannochloropsis_gaditana
MASDRGTGPGVLFAIDKGVQQLLSSLSETGAWLGRVRDVDIHRLGYLVDRLLESLHHNLPEAERLLYSWADTIFAPKVVLRQYLMALGLEMTLFIYHLCYRLGARLVNRMTVKGRQISETRRRMAKAKNYYEWLKCAERMDELERKNRWREVPESTLYNHRMLQEKINQFNNMMQNGDVFQLMFVLRGGISRNQFGLLNEGLYQHAYSGTKKIVERYLEVVVKALNFVCDVNPSLDNISADVKLAFFNETRHAFGRTALLLSGGAGLGFYHVGFVKALFDQGILPRVLSGASAGSIISSMIGVRTDDELYAMFTDGIARLDFFKLYKRRTKAAAAATAYGKKKPARP

SEQ ID NO: 8816 - protein, 470 aa, Nannochloropsis_gaditana
MEKLSLAVVGSLAVASAFQPSSSFLLQHPSLSSRSSPATRKAGSISMDLPPLQRKRVVITGVGAVSPLGWGDDFWNGLIEGRSGIVRLPSWADDYPARIGGLVPDSFKPSDYMNAKEVKRQARFTHFAMAAARMAVEDAKLDLDKTDRSRAGCMIGSGIGGVEVFEKNCAEFESKGGGLPGLKAVSPFLIPALIANTAAGTVAIELGLKGPNYCSVSACASGTHTIGDAFFFLQNGMADVCVTGGTEAAITPLCFAGFVAIRALTTSGNDDPAKASKPFDKNRAGFVMAEGAGMLVLETEEHAKARGATIYAELAGYGASCDAHHITAPHPEGEGLANAMNMALACAGVQPQQVDYINAHGTSTAYNDKFETMAIKRVFGDHAKNLKVSSIKSMTGHSLGAAGAFEAVACAKAIKEGIIPPTINYETPDPDCDLDYVPNKAIKHDINVAISDNLGFGGHNAALVFKKYVP

SEQ ID NO: 8817 - protein, 453 aa, Nannochloropsis_gaditana
MRSAIVLGGFMAFLLEVSHAFTRPAPVHMSIGHAAPSNTADSLRQTVDLALSPDSKKRKISLLGSTGSIGTQTLDIVRERGDIYEVTALAAGNNVDLLAEQIKEFRPAVASLQDPSRLPALEARLTQLGVPRAEWPMLGAGQEGVIACATEDAANVVVTGIVGCAGLLPTVEAIKARKTIALANKETLISGGPAIVPLLKEYGVNVIPADSEHSAIFQSLQGVPPGGLRRIILTASGGAFRDWPVEDLKKVTVADALKHPNWDMGAKITVDSATMMNKGLEVIEAHYLFGTPYDDIDVVIHPQSIIHSLIETQDTSMIGQLGWPDMRLPILYSISWPHRIPMPYKPLDLVQLGSLTFKAPDNKKYPCIQLAYAAGRTGGTMTAALNAANERANEIFRQEKIGYLDIAKVVEGAMESHKKDWKEAPSLEDIVAVDAWARVRVDELAEKMKYVAA

SEQ ID NO: 8818 - protein, 903 aa, Nannochloropsis_gaditana
SSSSSLFSTLTPASDTAAPKSGGEDGGNFKGAPWPDEVDYDDLEDKGSQALKAAALPLWQQDILKLEFPVEKSQRDFWTHYEVMETKDTTDAERQYWTHSGVLEEKDWSDSERNYWAHYETMQSGENTKEFQYWSNYGVWQEEYKSLSAEDQKKFTDWRYFWAVNGDGVTVGSKGSDLKTGLRTEFPLGLIEGQENIKTALLLTAINPDIQGVIISGEHGVGKTVMARGLKNLLPPIEVVKGSRFNLDPEDPDSADTFIKERLKSSRRNWKDLETEIIPAPFVEVPIGVMEDRLLGSIDLEESIRKGKAAFQPGLLADAHRGVLYLDDINLMDTQILSIIFNCLSQGYVQVEREGVSLRYPFKPILLGTFCPDGGDFSDFFLDKVGVALSADAVPLSDDQRQAAVEKILAWDSGVMSAEEKQAYLDQEEELKTRIIFAREELEEVKFTRSQIKYLCEEAIRGGCEGHRAEIFASEVAKAHAALNDRRKPSADDLRLGIKLAMIPRSKFVTDPTEEMMEQPPPPPPPPPQQPPPDENMDDQQEKQEEDEEEDQEEDEDEDQEPPPPPDLDDVPQEFMFDAEGVPMEAELLSFSMKQRQGRSGGRGVIYSMERGRYVKPMLPRGRAWKVAIDATLRASAPYQRGRRERYADTPKAGRKIYVEKEDFRAKKMARKAGGLIVFIVDASGSMALNRMTAAKGAALSLLNEAYKSRDKICLITFQGDRAEVLLPPTRSIAMAKNRLETMPCGGGSPLAHALQMGVKTGQNAMKQGDVGSAVLVCISDGRANVPLSKSMDVMPIGDPLEGLEEGGKEKKKDKEAEKKAREEIKEEVLNTARALGVLPGFSLLMVDTENKFVSTGVAKEIAAAAFGKYHFIPKATDRAVAEVASMAISDIKQSKNNVKSRR

SEQ ID NO: 8819 - protein, 2366 aa, Nannochloropsis_gaditana
MSAGVPLSSTASSGPLSPRGNFSSVEEYVEYVGGQRAIKKVLIANNGIAAVKAIRSIRRWAFETFQDERAVSFVVMATPDDMRANAEYIRMADEVVDVPGGSNNNNYANVMLIVEIAERWQVDAVWAGWGHASENPRLPDSLAKTDRKIVFIGPPGAPMRALGDKIGSTIIAQSAGVPVIAWNGNGIVCDYATGGLSDEVYARANVLTAEAALEAAREIGYPVMVKASEGGGGKGIRKVMDADSMPALFRQVLGEVPGSPVFVMKLAPASRHLEVQLLADVYGQAIALNGRDCSIQRRHQKIIEEGPPVAAPPAVWKEMERAAVKLAKEVGYVNAGTVEYLFTNEDQSFFFLELNPRLQVEHPVTEMITHVNLPAAQLQVAMGIALHRIPDIRRLYGLEALGDSLIDFDEAERVPPMNHCIAVRVTAENPDMGFKPTSGTIQELNFRSTPDVWGYFSVDSSGLVHEFADSQFGHLFAKGETREAARKAMVLALKELSIRGDIRTTVEYISVLMATEDYVRNRLDTTWLDKRIADPLEKKSRAGRPEPTLVVTVGGIIAAYRRATLKATSFVELLSKGQFPSERDFLIQQEVDLIYEDVKYQLTAMQTAPGSFLLACNGSTVTAEIRSLADGGFLVIKGGKSHVAYMKDEAGGLRMVLDGQTCMFTKEYDPTRLSTDVAGKLARCLVPDGAHLKKGEPFAEVEVMKMFMNVTVSEAGTIRWKMSEGASLAPGSLMAELELDDPDCVTKATVYAGSLPVSDTLGPVHSKPHHSLKAALSCLELVMNGFCISREVCDQALEDISLAVLDPLLPAYEIEEALAPVSGRIDQSLAAAIAELVDGYRARVEGTFPQHKAGAVSFGGLFMDDFPAIQLLNLINEHALALPDRDQAAFLTTTATVRTITEHYVNGIPGRTVVALLGVVRQYMNVERHFSGYQYQDVVQRLRRAHLGELHLVYDMCRSHAALPRKNSLLLTLLEHISVAASKARDQDLAHGSIIPTPLSQASTLSDVASPAELVPTPSTTPKRDASLMGPGQLKRSLVEGTDVNVFIPVLTELSNLNDTAYAIVANAARSILIEQTIPTVEQRRQKLKAVLEDVLSTGTGTERAERIEEFLEENVRVGDLLFYFLRKSDKQTQGAVLELYIRKIYKMHKIKSMETASSLTGEDDVTCATWSFFAEAAEALPAGISSVSSFLDLTQLVRARSGGAISSGNDSEGNDSEGGLGNGSSYKIPAGVSRAGVFARFVRFDQVLEHFPHLLSKFPKQSGLIPRAATGGPVNALHVLVLRDAADDADATAKRLTAFLRQHLEGLKAAAVRRVTFMLWHKEGKGEKEDQFQAPAIYTFRSKNDFEEDSLFRHIEPSHAFHLDLVRLSSFNIKLADTHQIESSFVHLYEAVPKRSVAVLAGLKPPFQKRFFARLVSTTITDHIPSEFERLMVESFNALHLAIGKEEEAALKARGKTIPPNNNHIFFNFLAANTVVEPVLVADLLRTLMGRYQDKLLRLGVVNVELKLVCRLGEDTGPVALRLLASNPTGYVLRVDSYVEVREGARTIYRSIGGGKSGEFEGMDVNVPYSVTRPFEKKRQTALAASDTLYAYDFLELLERSVQLKWEEYAKCRPRSDILRPRNVISVVELVVARRGTPLSVLEDGTGEEWAAQEEEEGLLELLEVSRPPGLNTVGMVAWKVTLFTPEYVEGRQIVLIANDITIQAGSFGTREDTVFSFASRYARAHGLPRIYLAANSGARIGMADSVKAKFKVAWNKEDDPNSGFQHLYLSKEDYPALASAVRAEMLVDPATGEERYVIKDIIGLPSEKDLGVENLKGSGTIAGETSLAYNDVFTLTLVVGRTVGIGAYLVRLGQRTIQKSTNAPIILTGFQALNKLMGKAIYTSNDQLGGQMIMFPNGVSHTLVENHLEGVLAVLTWLSYVPSVRRGFLPIHDITGVDVVERAISFTPQKGIAYDPRHLVGGTTNELDGTWISGFFDRNSFIETLAGWAKTVVVGRARLGGIPCGVIITETRTAEATTPADPADSSSQERNIQQAGGVWFPDSAYKTAQAIRDFNGEDLPLMIFANWRGFSGGQRDMFDEVLKFGSMIVDALVAFAQPIFVYIPPQAELRGGAWVVVDPTIHAEAMEMYAATASRGGVLEPNGAAEIKFREKDYVAAAHRLDPVLRAMDAKMELLEAAGEVEGEEGKQLRRERKDREDALKGIYAQVAVQFADLHDTPGRMEAVGVIRKVVPWGQARSFFYWRLRRRLAEFHLRKEVLKAVDGKEGGKEGGMTLLQASALLKSWFVATPGKSTEGWEEDREVLGWMAEHQGIEERIRALAQGRVAKEVASLAAVSTQGAVDGLKHVLKTLPAEHRAALLAALKE

SEQ ID NO: 8820 - protein, 833 aa, Nannochloropsis_gaditana
MVQREAMPGFWQTLLEKRGSSNGDACVMLPLLATILCILGASIYSSYIARPTSYPGGPRAQKQKRRAAWLPRSSIFSPGWVFAEAETSVAVTEREVLTLLGEPVPLTGEAAGRQTWHWDPKKGKDLAGRKADYSFSAARNPNSADKVFRTQQVNQWKGPRPNSKSRPKTAREAAHKAMAYYQMLQCEDGHWAGDYGGPMFLMPGLIFACYITDVPLGEARTTAMRAYLLNHQQSDGGWGLHIESPSSMFGTVMSYVSMRLLGLPQDHPACTAAHAFIHLNGGATMAPSWCKFWLAVLGLHEWEGINSVPAEMWLLPRWFPFHPGRLWCHCRMVYLPMCYLYCRRFSANATEDPLLLSLRKEIYVQEYKEVAWDRERHACSELDIYDPVSGLMKFLQNLLAYYERAPCTWLRKQGLDFAIKYIHAEDAQTNYVDIGPVNKTLNMLCVFAEGGKESEAFKRHLSRLDDYLWVAEDGMKMQGYNGSQCWDTSFLVQAVAEAGLIEDFPEAMMRAYSYLDRTQIKADEDNASYWYRHKSKGGWPFSTAAHGWPIADCTAEGLKGILALMESPGLQEKGLTPLPSSRLEDAVGLLLSYQNSDGGWATYENNRGWGWFELLNPSEVFGDIMIDYSYVELTAATMTALATFHQHSPTYRAEEIARALARGASFLRAIQRPDGSWYGSWAVCFTYGTWFGIEGLVAAGEDPHASAPIQQALAFLLSHQRPNGGWGESYLSCVDKSYPEDGTGQGLGEGGSGVVQTAWGLLALMAGKCQDKAALERGVRFLMERQEEDGDWAQEGITGVFNRNCGITYTQYRNIFPLWALGRYAREVKVSKE

SEQ ID NO: 8821 - protein, 738 aa, Nannochloropsis_gaditana
MAVGTKILIGACLLTVSLAKNAVGAFVPHADSTASNRRLHSRRAALQMDGKDISHLKKYCESVYQTKRRPTRTVWAGKVPIGSEHPIACQTMGTTDTRDVKATVEQAMRVADVGGDLFRITVQGKKEAEACHAIREELFKRGYDIPLVADIHFQPKVALLTAEAVEKIRINPGNFADGAKKFTVIDYENEEDFRREVEYIEEVFTPLVEKCRGLGRAMRIGTNHGSLSARILSFYGDTPKGMVESAFEFADICRKNDYHNFLFSMKASNPLVMVQAYRLLAAEQYAKGWDYPLHLGVTEAGEGEDGRMKSAIGIGSLLMDGLGDTIRVSLTEDPEYELAPCRYLAEEVGKKATQDTRRAEAVPSWTETQRDFTNYGKRKGDLPTQEAGDAIDFRSVLHRDGSVLSAVSLEDLARPDTLYYNLGCKTAVGVPFKDIATSDSLFLRQPPPVDDKEGRAALRRLQESGLGLLSPASTLATAPVPNAIAVYDLAALPPSGPPSLPPQAARYAVTLSGKETEEELKKLKEASPVMVLLAIDPSLSRVHASRRLMEWIVREGLSFPVIHHFISEPGVSKDELILRAGSEVGCLLVDGLGDGVMMEAGDQDLAFLRTTSFATLQGSRMRNTKTEFVSCPSCGRTLFDLQETTADIQKKTGHLPGVAIAVMGCIVNGPGEMADADFGYVGGAPGKVDLYVGKEMVKKGIPNEEACDALVDLIKEHGRWVDKAVEEERPAEKEAVSA

SEQ ID NO: 8822 - protein, 515 aa, Nannochloropsis_gaditana
KTTGKTTGPSILTPPGNMTSLIHEKHLDALVSFFQSWVPLADKTVYLTVPGMDQALAPLGETLGFDIGMLKYVLAMFLAYPLSGILTLLPSTNAKHAFSLLLGLWYAQEIFGNQWIHSFLSAAISYLIICFGPRKHIATLVFLFTMTYMSLSHLYRLYVDYLGWSLDFTGPQMILTIKLSSLAYNVYDGREDLANISTPQENKLKARVFKERLRYALPTIPSPLAFFGYVYSFSTFLAGPAFEYADYASVVDGSAFARKGKGGNARPSSLLAALWRLLQGVLCLGLHLVGSAKYSLNDVLSDKVLAMPFFERLVFTLIALFFCRMKYYFAWKVAEGSCVVAGFGFEGYADDGSVRGWDGISNMDIWAFETATNTAEAAKAWNKGTQRWLQRYVYFRSNESLLLTYFVSAFWHGFYPGYYLFFFSVAFVQSVQRAWQKKVSPYFASVPRLYTLLSIAFFSAYINYFSIVFQVLAWDRALAVWKSANYWGHAATAAAFLLTSILPTPPKEKGAGKKA

SEQ ID NO: 8823 - protein, 716 aa, Nannochloropsis_gaditana
MTTANARLSRLKDHLAETGAVARAPISSSAINATPFAARTTHTMERMARERAKASFPVRDMTYFLDGGRSMTEVKEGMMADLAANPVFTDPEWNDLNRDQIRERTISRLRAAYKLLIRDGADVSRRNARLEIHALHDLGWYVRQGVHFGLFMGALAGQGSDEQRAEWLPRTMMCEIYGCFGMTELGHGSFLRGLETTAMYDKDTQEFVINSPTDTSTKWWIGAAGQTATHSVVFARLLLPSGDDMGVHNFIVPLRDMETHLPLPGIHIGDLGAKMGLNGIDNGWMQFDHVRVPRDNMLCRYAQVTPEGKYIRPPRKEMAYGALIGTRAALVKTAVDFQKKALMIGIRYTALRTQGVVEEGQREETAIIDYPIHRDKLLKLLAAAYAWHFQAAYVLHLNDSLEEGLEAGDLSILKDVHGTMAGLKAFGTWFTYNTIEACRQVCGGHGYSKYNGLSNTLQDFAVMCTWEGDNTVMALQTARYLVRSYEKAKRGGETLAGSVSYLQDAHPPAWRARSAEDLLNMEVQMEAWRALLAAKVSRASERVLARQAALRGNEAQAFNEHQVELFECAKTHVYFNVAARFAEAVVEAGTTHPALAPVLARLCHLFSLSSLLEDEASLLASGFASAGQMQLIREAVGALLLALRPDAVALVDAFNYSDEVLNSHLGTANGDIYTGYLQQVQRLVPENKLAVAPYIMREVKPLMQGADLISTDEEED

SEQ ID NO: 8824 - protein, 454 aa, Nannochloropsis_gaditana
GKTTGCTIVVERMLRSSTLLRGLASKAAGAGKKPTVVFVDGARIPFAQSSTVYNDYLGVDLQKFAYKGLVDKTALDPKEIDYILGGNVIQEVRTSNIAREAAMAAGLPTDIPAHTVVLACISSNVGICSAAEKVLTEHASLVLVGGVETFSDVPIRLTRPLRQALITLPKAMKKGPLGVFKHLAKLNFKDLGLETPAIANYTTGEVMGHSSDRLSAKFGVSRREQDEFAALSHQRAAKAHKDGIYKDEIIPVDGNTGENGIKGESTADTLAKLKPAFVKPHGTHTAANSSFLSDGASASLIASEEKALSLGLKPKAFLRAWEFVAVDPFEQLLLGPTYATAKVLSAAGLTLADIDVIEIHEAFAGQVLSNIRAMGSDKFAQEYLNRSTKVGDIDMAKTNLHGGSLSLGHPFAATGNRLVTTAANRLHREGGKYALVTACADGGLGHACIIENYE

SEQ ID NO: 8825 - protein, 454 aa, Nannochloropsis_gaditana; identical to SEQ ID NO: 8824

SEQ ID NO: 8826 - protein, 454 aa, Nannochloropsis_gaditana; identical to SEQ ID NO: 8824

SEQ ID NO: 8827 - protein, 271 aa, Nannochloropsis_gaditana
LQAKLRLLTLSNEAITRREEIRREIQMDLIDEAQAQGVSVAAKMKQSETPWFVLLPYYALCAFLDAVYEGRPLARFWFLETVARMPYFSYISMLHLYETLGWWTIGTDVRRVHFAEEWNELHHLQIMESLGGDARWLDRFLARHSAIAYYWILNLILLISPRLAYNFSELIESHAVDTYSQFLDENEDLLRRLPAPRVALDYYVMGDLYMFDEFQTTRPVQTRRPLIRSLYDVFSAIRDDESEHVKTINACQVADEVILSPNAAAAHAAWA

SEQ ID NO: 8828 - protein, 484 aa, Nannochloropsis_gaditana
HSMHASTLPRPVASHWRIESLRQSRARINHKMRGPKARGPLSFLPPLYARLDVPNRVHLITYLSLAYTYAIVPYHVHIRVAWKGSSSSARPETETRTATPRPTCVTGQHHTSCFLLFGFVFLEASPEKRLKKDKRNFCSRRPPSLSASSHARRLGESEEGGSLHQVLGVAGDAAVVRQGQVAEVGGEVVELAVGQGVGRLEQVPVHRLSLLGLAGRGGEGAHVVPEGVVLGEDVVGVDLVLGGQVGVVGVCLRLVRLQGLKERGGGPGREEDGEDGDVLGTVYLGVDEMDLQRHVGEVDGVLRVVEVELEEFVVGAPDLGLEGARVRDNHLPRPLLELNEGFARVPGEGHGPVRLVHGREGGAHGLDVDGALLVSLHVGAGGGRGLIDMDPVVGTASLLPVFGLPAAPERLGVRVVTGCVVHIVDVAPGLHLLKVFHACGSLDQGQGGHHEGQACCRGREDLHGVLRKKIYAGRVARKLSVVFP

SEQ ID NO: 8829 - protein, 161 aa, Nannochloropsis_gaditana
SKVFKNKQIKQSLRENNRHPNPSSSSTPMAEPEATKASTAGIPEAEKAEKIVLWSFAEPHMRAFHLAWVAFFVAFNAWFAIAPLMPVIKASLSLTKSQVQISNLTAVGSTVVGRVLIGPLCDRYGPKTTMAALLLAGAVPVFCIGFVQTWQEVKKAYPNNF

SEQ ID NO: 8830 - protein, 332 aa, Nannochloropsis_gaditana
REGRREGRRASFESSTFGLGGGGGKSVLEPAQVAFGEVLRELLLEVFWYGDGVFLMDTEHFRRRLLSNIGNYTFQEAFDRTGRILNIIVAPANNSDPPRLLNYLTSPHVLVWSAAAVSSAAPGIFEPGYLYVRQADGSERPESSCKWYDGSVEKDLPMEQLAELFNINHFLVSQVNPQATLFSSVALPQRIWASPLLAVLAHVMQFCKRQFRSWCRNFFQLLESSRHQGAFSVRSIGLMFTQDYEGRDCDITIMPWAGHIGFIGVCSRILSNPSFQDYLEMLAYGERKTWPMLHAIRSHCVVEMCLEKCVQRLRRTVAKNSHSKGPSLPPSL

SEQ ID NO: 8831 - protein, 1415 aa, Nannochloropsis_gaditana
MHITTVAVIAWLGVATAFIPSQIPRRNALGVSPAYPKAVAPAASFTRRVAVSMSSILDRKTEKKPKDVDASFGSGGLFTTSSQEQRRVVPVENGRKKFKVVYVVLESQYQSTLTAACSRINENQENVCVECVGYLLEELRNPETLEEMRKDVADADIFIGSLIFIQELAEKVVEVVSPLRENLSACLIFPSMPEVMRLNKVGSFTMNSLGQSKSIIGDFMKSKKKEGGSGFEEGLLKLLRTLPKVLKYLPSDKAQDARSFIMSFQYWLGGSPDNIESMLLMLANTYIDEVKDSQAVETKDISEPILLPDKGIWHPIAQKVFEDPSEYLAWYDREHAPLVGLDPASAPTVGVILQKSHINTKDEAHYTSLIAELESNGARVICIYSGGLDFSGPIEEYFYTKQGVVVVDTVVNLTGFSLVGGPAAQDHDKAVQVLKRLDKPYLCAVPLVFQSFEEWKASELGLHPIQVALQVSLPEIDGAIEPIIFAGREGATGRSVPLADRVQLLAERALKWASLSRKQNKDKHLAITIFSFPPDKGNVGTAAYLNVFDSIRSVLLEIQKQGYDVTDMPLTAEGLMNDVLHDKEARLSSPELNIEYRMPIDEYQRLTPYAAELEENWGPPPGNLNTDGKDMLVYGKRYGNVFIGVQPTFGYEGDPMRLLFSKSASPHHGFAAYYTYLEKIFGADAVLHFGTHGSLEFMPGKQVGMSDTCYPDRLINTIPNLYYYAANNPSEATIAKRRSYASTISYLTPPAENAGLYKGLKELGELVGSYKGLRESEARGPPIVNSIVAAARQCNLDSDITDLPSEDVDCKTLSIDERDNIVGKVYQKIMEIESRLLPCGLHTVGVPPTAEEAVATLVNIASLDRPEEKIKGLPRIIAESIGRDINDIYRGNNQGVLQDVDLNRKVTTAVRAAVGAAVKSSTNKDGRIEQVETIFSEGMKFLEGLMSKIKPTPWREALVEAGFPNVKEEDLTPLFQYLEFCLKQIVADNELGGLLEALNGKFIIPGPGGDPIRNPDVLPTGKNMHALDPQSIPTAAAVDCATDVVNKLIERLRVDNGGKYPETVAFTLWGTDNIKTYGESLAQVLALAGVRPIADSIGRVNKLELIPVEELGRPRIDVVVSCSGVFRDLFINQMNLLDRGIKMAAEADEDPEMNFVRKHAMEQAEELGVSVRDAATRVFSNAAGSYSANVGLTIENGGWDGEAQLQEQFVSRKGFAFNADRPGMMEQQTDLFRTALKSVDVTFQNLDSSEISLTDVSHYYDSDPTKVVQGLRDDKKKPMSFIADTTTANAQVRSLSETVRLDARTKLLNPKFYEGMLATGYEGAREITKRLRNTMGWSATAGEVDNFIYEDANDTFIKDESMRERLLETNPNALRDMVTTFLEANGRGYWETSEENLDILRELYEEVEDRIEGLA

SEQ ID NO: 8832 - protein, 404 aa, Nannochloropsis_gaditana
MRHILSLFLAPTLMVTGFLLPRLPQYHTTSRAASPLRMVLPSAKEGKGKVASFYPFETSLGVKGKKDNSEVGTDAARQLLGMKGAAQTDDLLKIRVQLMKPVTWIPLIWGVVCGAAASGNYHWANPFDQGSPDAVPLSLGLEDAAKAVTCMVLAGPLLTGFTQTINDWYDKDIDAINEPYRPIPSGRISEGQVKGQIWGLLLGGLGLAALLDVWAGHETPTILGLSAFGSLISYIYSAPPLKLKQSGWIGNYALGCSYISLPWWCGQAMFGTLNAQVVVLTILYSLAGLGIAIVNDFKSIEGDRAMGLQSLPVAFGIDAAKWICVGTIDVTQLGVAGYLAYIGETAYALALLGLILPQIFFQFKYFLKDPIEYDVKYQASAQPFLVLGILTTALAVGHHDFASI

SEQ ID NO: 8833 - protein, 427 aa, Nannochloropsis_gaditana
RENNRTLSMLCSGSALRYNTTALLLRRGAARAAQQNLNGRARAYTSVSTLPEEYRSIRDMVRSFADTELVPNAAQWDREHVFPADQVKAIGEMGLMGVSVPEEYGGAGMDYMAYAIAIEELSRGCASTGVIASVNNSLYCGPVAQFGTDEQKDTWLTPYASGSQIGCFGLSEPGNGSDAGAASTTAVLEGEEFVLNGSKAWITNAHEASAAIVFATTDKSLKHKGISAFIVPCDAPGFSVGKKEEKLGIRASSTANLNFEDVRVPKANLLGELGMGFKIAMVTLDSGRIGIAAQALGIAQAALECAVKYSKERKAFGQPISKMYAIQLKLSQMASALESARLLTWRAAQLKDAGEDFVKEAAMAKLQASEASTFVAHQAIQVLGGMGYVNDMPAERHYRDARITEIYEGTSEVQHLVIAGKILKEYE

SEQ ID NO: 8834 - protein, 288 aa, Nannochloropsis_gaditana
MRLAVYGKGGIGKSTTSCNISVALAQRGKKVLQIGCDPKHDSTFTLTGFLIPTIIDTLQVKDYHYEDVWPEDVIYRGFNGVDCVEAGGPPAGAGCGGYVVGETVKLLKELNAFDEYDVILFDVLGDVVCGGFAAPLNYADYCLIVTDNGFDALFAANRIAASVREKARTHSLRLAGLIGNRTATRDLIDKYIQTVPIPVLEVLPLIEDIRVSRIKGKTLFEMSTIDPSLEYICDYYLNIADQLIAQPEGVIPKESADRELFTLLSDFYLKPANSEQNVEDLEMDLFNN

SEQ ID NO: 8835 - protein, 444 aa, Nannochloropsis_gaditana
MNIEQGSLINSNSITFECETGNYHTFCPISCVAWLYQKIEDSFFLVIGTKTCGYFLQNALGVMIFAEPRYAMAELEEADISAHLNDYMELKRLCTLIKKDRNPSVIFWIGTCTTEIIKMDLEGIAPKLENELGVPIIVARANGLDYAFTQGEDTVLAALAQTFGKKSTTSDNGTKSENTPNLVIFGSVPNSVVYELGNELKTYGIEIKGWLPAKRYTEFPILNEKDFVCGVNPYLSRTATTLMRRRKCQLIGSPFPIGPDGTKAWIEKICSVFNKPTPGLNDREEKAWKNLESYLKLLRGKSVFFMGDNLLEISLARFFIKCGMSVYEIGIPYLDKRYQGGELALLEKTCKEMGTFLPVIVEKPDNYNQLNRIKDLHPDLVITGMAHANPLEARGINTKWSVEFTFSQIHGFTNAKNILELISKPLQRQTTFKELGWKNYHTLV

SEQ ID NO: 8836 - protein, 507 aa, Nannochloropsis_gaditana
MKLAYWMYAGPAHIGTLRIATSFRKVHAIMHAPLGDDYFNVMRSMLERKRDFTPVTASVVDRHVLARGSQEKVIQNIKRKDKEEQPDLVLLTPTCTSSILQEDLQNFVNRASQDSKADVLLADVNHYRVNELQAADRTLEQVIKFYLEKAEKDNSIFSKKTEKPSVNILGPCNLGFHVHHDIAELKRLFKDLSITINTIIPEGASIDELKKLPQAWFNIVPYREVGLLSAQHLEKNYDMPFISTAPIGIVETANFIRQIQTLLKQLGQNVNFEKYIDLQTRFVSQSAWFSRSIDCQNLAGKTAVVFGDATHTVAITKILSQEMGVRVLVAGTYCKPEEIWFRKEISKYCEDILITDDHNLVGDIIAKLEPSAIFGTQMERHIGKRLNIPCGVISAPVHIQNFPLSYRPFMGYEGSNQIADLIYNSFTLGMEDHLLEIFGGHDTKDISSSTLSNENIWEIEAENELKRIPGFVRGKIKRNVEKFAKINNLNKITLDVMHACKEAGNMQ

SEQ ID NO: 8837 - protein, 347 aa, Nannochloropsis_gaditana
MTDSMVSSKTPAKESLLTPRFYTTDFEEMANLDVSSNIEEIEAILEEFRRDYNQRHFIRDKEFSESFSKIPEETRSLFIEFLERSCTAEFSGFLLYKELSRNLKTQNPLLAEGFALMSRDEARHAGFLNKAMSDFNLILDLGFLTKSRKYTFFAPKFILYATYLSEKIGYWRYITIYRHLERAQKDRIYPIFRFFESWCQDENRHGDFFAAVLKSQPQLLTGLQSKLWCKFFLLSVFATMYLNDCQRSAFYNAIGLDARKFDQYVIRKTNQSSQKLFPIILDVENPIFFKYLDECAETNLLLQNLDKESSFSAIIKKFNYTFKIISKLVSLYFLKSIPTDNTWTSVQ

SEQ ID NO: 8838 - protein, 386 aa, Nannochloropsis_gaditana
MDDTRLINKELQKNGISSSNQSKTKKTRASFPFLAIQGQNDLKLGMILNVIEPDIKGILIIGDRGTGKSTTIRAFANLLPEIIVVKGDPYNRAPISIRKTVPFQATKPNQDNLVHRVHSSYLRIQSDRIEVKTMPLVDLPLGATEDRICGSINLERAVTEGEKAFEPGLLAKANRGLLYVDEVNLLDDHLVDILLDASASGYTVVEREGVSVRHPSKFILIGSGNPEEGEVRPQLLDRFGLYTEIKTVEQPLMRVHIIDSRVDYDDSDNVWRNNYWAQEEYLKEKIERAQFLYKCVKLPESLKQAASRMCSALNVDGLRADLVICRAAKALAAFNEEETVTIEHFKRVSQLCLRHRLRKDPLELIDSGRRVDDLFTISFEENEVLT
